United States Patent 7,906,278 (DIAGNOSIS OF OSTEOARTHRITIS BY DETERMINATION OF ASPORIN RNA LEVELS) - sequence listing, part 6

SEQ ID NO: 39806 - DNA, 294 bp, Homo sapiens
  misc_feature 4: n = A,T,C or G
aganttacacgactgtattattattttgttcttaagagaatcacatgggaaaactgtggagaaagaaaggcaacaaagtaaatattagtgtttaatgactagatgtgtgagatatttatattacatattataataaatttaatgcttcatgacattgatctgtatgtaatttaaagagatgctcaaaattcagatcattggaataataagcaaggtagttttacattgctgaaaaaggtacatctaaaggcaatgtatttcttattgaaaattttgttgatagctgagccgttc

SEQ ID NO: 39807 - DNA, 426 bp, Homo sapiens
atgagaggtgtagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccggttggcaggagaggatgccggagatctctgcctttgagctgcagaccatcctgagaagggttctagcaaagcgccaagatatcaagtcagatggcttcagcatcgagacat

SEQ ID NO: 39808 - DNA, 419 bp, Homo sapiens
atctgcgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcaccgagaatcacttgaactcaggagatggaggtttcagtgagccaagaccacaccactgcactccagcctggcaacagagcgagactccatccca

SEQ ID NO: 39809 - DNA, 460 bp, Homo sapiens
gctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtca

SEQ ID NO: 39810 - DNA, 421 bp, Homo sapiens
ctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattttgtggccgagtgtaacaaccatataataaatcacctcttccgctgttttagctgaagaatt

SEQ ID NO: 39811 - DNA, 455 bp, Homo sapiens
gtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaac

SEQ ID NO: 39812 - DNA, 468 bp, Homo sapiens
  misc_feature 136: n = A,T,C or G
atctcatggatttgttaggagttctcttgtattttctgtattttatgtctgttgccaatgttttctcctacttagccatttggctttaattttacatggtgtctgtttaaataaatgttttatatttgtatacaantcaaattgattaattttcatgacttatttcaggatataaagcaaattattttctaagacatttacagtgtattgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgt

SEQ ID NO: 39813 - DNA, 425 bp, Homo sapiens
gcacatgattctccccgtgacgaagcactgcagaacatctcggctgatgatctcccagactctgcaagccaagcagcccacccgcaggattcagctttctcttacaggtatttcttttataggatttgggactttagggtttggacttttcagcaccattgcagtcacgtcaagtcaagtgatgttttgagtcaataaatgtataaagcagggagagaaaaatgaaatgctgtttactaagaagactttgtttcagttgtagatgttatgtatcaaaaggtgttaattcaaggatttaaaaaactcgctgggcgtggtggctcacgcctgtaatcccagcactttaggaggccaagacaggcggatcgctggagcccaggagttggagaccagcttgggcaacatagcaaaatcccatctctaca

SEQ ID NO: 39814 - DNA, 140 bp, Homo sapiens
aagaggtgaactggacgttgtgaacagagttagctggtaaatgtcctcttaaaagatccaaaaaatgagacttctagcaaggattatttgccttatgttatgggctatttgtgtagcagaagattgcaatgaacttcctc

SEQ ID NO: 39815 - DNA, 484 bp, Homo sapiens
gaaggttttctgcaacatggaagactggcgagtacttgcgtctaccccaatccagcaaacgttcccaagaagaactggtggagcagcaagggcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggag

SEQ ID NO: 39816 - DNA, 292 bp, Homo sapiens
gtttgaggttaccagtaaattttatttttctgtttactttagacctttgtctgtagttgtagaattgaagcagcaagctctccgtgtgtctctgtgtcaataattgagaaaggcatttcctttttattgtgtgtgcatgaaatatttcctacctctggagggtattaatacattaaagctataaaacctcttaaattaaagaagctctgttctgcttggttcgtagagaacaataagaaccacataaatttaatgtttacagaattcttataaaataaagaaactgaacttc

SEQ ID NO: 39817 - DNA, 101 bp, Homo sapiens
cacacctgtaatcccagcactttgggaggacgaggcaggcaaatcacctgaggtcaggagtttgagaccagcctggccaacatggtgaaaccctttctcta

SEQ ID NO: 39818 - DNA, 167 bp, Homo sapiens
gtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggtt

SEQ ID NO: 39819 - DNA, 459 bp, Homo sapiens
aagctctgtttggtgctttggatccatttcctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatat

SEQ ID NO: 39820 - DNA, 391 bp, Homo sapiens
  misc_feature 7: n = A,T,C or G
gaaagancttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcaagtgcctgtttatgaac

SEQ ID NO: 39821 - DNA, 146 bp, Homo sapiens
gcagctaggaataatggaataggaccgcggttctattttgttggttttcggaactgaggcattgaggcagccagcgcaggggcttctgctgagggggcaggcggagcttgaggaaaccgcagataagtttttttctctttgaaaga

SEQ ID NO: 39822 - DNA, 151 bp, Homo sapiens
  misc_feature 29, 48, 49, 68, 115, 127: n = A,T,C or G
gggactgcatgctactgtctagagctggnctcaatggatctagaactnnatcgccctctgatcgccgntcacctctgagacccaccttgctcataaacaaaatgcccatgttggncctctgccctgnacctgtgacattctggactatttc

SEQ ID NO: 39823 - DNA, 216 bp, Homo sapiens
  misc_feature 23: n = A,T,C or G
caaggtcttccatcaaatacagnatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtctt

SEQ ID NO: 39824 - DNA, 112 bp, Homo sapiens
tgcggcggctcatgcctataatcccagcactttgggaggctgaggaaggaggatcatttgggcccaggagtttgagaccagcctcggcaacatagcaagaccctcatctcta

SEQ ID NO: 39825 - DNA, 473 bp, Homo sapiens
attgtccttttatccctcccacaggtagtcactgagttctaataccacagagtcttttgactttcttttgagccttatgtaattagaatcacaaaagatgtattcttttgcctgacttttatacttagtattgtttttgaaattcatcttgtgtgtaactgcgatttgttcattttcattgcttagtgaattattccaaagttggatatacctggttaaccaccacccgaatgaaaaaaacagtttttggccgggcacgatggctcacgcctgttatcccagcactttgggaggctgaagcgtgcggattacgaggtcaggagatcaagaccatcctggctaacacggtgaaaccccgtctctactaaaaatacaaaaaattagctgggcgtggtgacgggcccctgtagtcccagctactcaggaggctgaggcaggacacctgtaatcccagctacttgagatgctgaaac

SEQ ID NO: 39826 - DNA, 467 bp, Homo sapiens
gacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtatttttgaat

SEQ ID NO: 39827 - DNA, 471 bp, Homo sapiens
attttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatct

SEQ ID NO: 39828 - DNA, 387 bp, Homo sapiens
aagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttattgtagtg

SEQ ID NO: 39829 - DNA, 420 bp, Homo sapiens
agccccaccacaaccaagatatagaacagttccttcacaccccaaatttcaccctgtgaggtcagttcctctctcgatttcagaccctgacaaccaccgggactgttttctgtccctagagccttgccgtttccagagtgtcaaaaacagactcatacagtgtgtagcctactcagtctggcttccttccctaagcttcctgcatgtgagcttcctccatgttgcaggtgtcagcagttctttccttttcatcgctgagtagtattctattgcgtggacgtaccacggtttatcattcaccagctgctcgggaggctgaggtgggagaatcgtttgaaccccagaggcggaggttgcagtgagctggagattgcaccgttgcactccagcctgggtaacaagagtgaaactccgtcacac

SEQ ID NO: 39830 - DNA, 235 bp, Homo sapiens
atcccattcatgagggctctaccgtcatgatctaatcccctccctctaaggtcccacctgcaaatatcatcatatgggtgttacatttcaacagctgaattttggggggcactatcattcagtctacagcactgtgaaatccctaatatcgagttttctttttaatttttgttttgttttgttttgagacagagtctcgctttccagccagggcgacagagtgagactccatctc

SEQ ID NO: 39831 - DNA, 260 bp, Homo sapiens
  misc_feature 7, 8, 23: n = A,T,C or G
atagacnnttagactgattcccntttctagcaggtacctaaaacaataaataaaaagacttcctttaattacctaaaaatccctagggtttttactataagagaataaaatttgaaagcaaactaaaagagaagtttgaaatatatatgacaaatgcctaatactctgattatatgatgagtacttataaataaaaaatttgtagttcatagaagaaatacaaatagctcaaaatttataaatgattcaatcttaagagt

SEQ ID NO: 39832 - DNA, 200 bp, Homo sapiens
  misc_feature 5, 9, 28, 34, 40, 41, 49, 97, 154: n = A,T,C or G
tggcnaacntagtgaccacccccttccntctacntaaaannacaaaaanttggtggggcgtggtggcgcatgcctgtagtcccaggtacttcaagangctgaggcaggagaaatcgcctgaacccgggaggcagatgttgcagtgaaccaagantgtgccattgccttccagcctgggcgacaaagcaagagtccgtctc

SEQ ID NO: 39833 - DNA, 493 bp, Homo sapiens
  misc_feature 3, 10, 26, 34, 35, 109: n = A,T,C or G
aanctcggcnttttggccgggcaganccaggacnngaagttgatgctactctgaagtctctcaacaaccagattgagacccttcttactcctgaaggctctagaaagancccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgttagaaggagtgacttccaaggaaatggctacccaacttgccttcatgcgcctgctggccaactatgcctctcagaacatcacctaccactgcaagaacagcattgcatacatggatgagggagactggcaac

SEQ ID NO: 39834 - DNA, 498 bp, Homo sapiens
  misc_feature 5, 16: n = A,T,C or G
tgaanaatttcctacntctctgttttagttggagatttcttcctggagtacagtttgctttcagggcccttgaactcaccccttctccacttttgccataaggatagctgcaccattccttaatttatggcaaaccacaaagtgagtggcctagtatcacttgctccagtgttatgagcacccaggagtagttaaaaggtagtagctatataaaatacctttctaggttatgtcaggtagaagctccaagttctatgttttgattctctctgtccagagtcagagaagcattccttccctacttccaaatccaaaatattggcttcctccaaggtatttctcattgaaatcttatccctggaaaggcagcacatggacatattctgctaattgccatttgtctgacagcaatgaaatttcaaacgtcatccagtcttgaaatctgtcccttgcccagacctgtttcaactttttcactctcccctattctgactgact

SEQ ID NO: 39835 - DNA, 424 bp, Homo sapiens
  misc_feature 400, 407, 408: n = A,T,C or G
cgggtcttacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttgggtttttgttttagtttttgggttgcgttgccttttttttttttagnggggggnnggccccatgaaggggg

SEQ ID NO: 39836 - DNA, 471 bp, Homo sapiens
attgtgatatagaggcatgagcctgaaataccaatttgtccccagactgataggtaaacagcaaataggaaagccttcttcttccctctcatccctgcattcccaaatatttggggctctatccaacagcctggatctgcagcaaacatttgcctctgactcaattgaccccttcatggcgaatcttacatccacattggataactctactggctcaatctatgaacaattttcaaaattgaggaaataaggcccttttccattcttaaataggctggcctaaatattcttgggagcttcatggagagtgtcatgccctggcttattcgcaaaggtggcaatggccttcagactcagctaagacaaacattggcacatgcaggtggccatcagatgttaatgtttatcttgttcctctgtattgctgttatctttcagggaaatctaggaatagcagaaagatgaatcttt

SEQ ID NO: 39837 - DNA, 479 bp, Homo sapiens
gagtgatgaaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagcctttcagtccactggcgagtctgaatggaaggatactaattatacactcaacacagattccttggactgggccttatatgaccacctaatggatttccttgccga

SEQ ID NO: 39838 - DNA, 245 bp, Homo sapiens
  misc_feature 4, 22, 29, 30, 34, 40, 44, 47, 50, 56, 57, 60, 70, 76: n = A,T,C or G
accnagcactcttgtgccctanactgaanngccnttcccntccnctngcngtggannacnacttttttcngttccngttttgtgcctcttttcctccaccttgtacttctggaatctttgtctccttttcacctgcccagtcacgaactttcagtggtctcttcttgtgcttgcatcaaacaagttatttttcttttacttgagtcatttccatcaatatggaaatgcttgttattttctcccat

SEQ ID NO: 39839 - DNA, 469 bp, Homo sapiens
  misc_feature 2, 9, 32, 105: n = A,T,C or G
cnacggctntttggtgtgttttaaacttggcnctcttgcttacctggacactaaaaacaagtcccagagaacaaggacaatgtcttcttcttcgtgtgtttctcntggggttttgtagtttgtaggttgaaatctttcctgcataaaagaagggacaaatacattaattagaagtacttaccatgtgatagctcttgtgctagatcttgggatacagagatgagagaacatttttctcaagaagcttatagtctaatgcagtggttctcaaagtatggtttgtaggcctctggtggtctctaagatcctttcaggtcaaagcttttataataatactaagacttctttggggggctttatttattggtgcagacatttatactaatggcacaaaagcaatggtgatgtgttagaactgctggtgacttaaaccatatcaagaaactgataccaaaccctattgattctt

SEQ ID NO: 39840 - DNA, 473 bp, Homo sapiens
  misc_feature 9, 114, 135, 247, 337, 369: n = A,T,C or G
gaagaaaanatctagaaactgagttgtggagctgactctaatcaaatgtgatgattggaattagaccctttggcctttgaactttcataggaaaaatgacccaacatttcttancatgagctacctcatctctanaagctgggatggacttactattcttgtttatattttagatactgaaaggtgctatgcttctgttattattccaagactggagataggcagggctaaaaaggtattattattnttcctttaatgatggtgctaaaattcttcctataaaattccttaaaaataaagatggtttaatcactaccattgtgaaaacataactgtnagacttcccgtttctgaaagaaagagcatcgntccaatgcttgttcactgttcctctgtcatactgtatctggaatgctttgtaatacttgcatgcttcttagaccagaacatgtaggtccccttgtgtctcaata

SEQ ID NO: 39841 - DNA, 499 bp, Homo sapiens
  misc_feature 13: n = A,T,C or G
tctggccgggganctgacttaccttctgtcttcttgaggagtgagagtggaaggaaatgtttggtgtgggttcctgggccaggaggttttctccctggggttcccattccagaacgctgtcctcattcatggttgctgttcacctttcaccactccctgcattatttcatgtgggcgaggaacgagtgtggaaatggggattggggactaatagacttgtctcttcaccaggtctccccacacttccagtccagaaaacactttttagttatagaaatggatatatccggctgggtgcagtggctcatgcctataatcccagcactttaggaggccgaggcaggcagatcacgaggtcaggagttcgagaccagcctggccaacatggtgaaaccccatctctactaaaaatacaaaaattagctgggcgtggtgggcaggcacctgtaatcccagctactcgggaggctgaagcaggagaatctcttgaatccggaag

SEQ ID NO: 39842 - DNA, 474 bp, Homo sapiens
atttcagcctagtgtagcctgagggcatagcttagaaatagaaagcgatataaccataaaaaataaccaagaaagttaggtttcttggttatttgctgtataagtgatttgctgtaatgggatgctttgagagctgttttcattttctattgatgctgtgacaaatcatcaagaatgtagtagttttcttacatttatgaaggtcagaagtgctaaaatgaaggtgtcggcaggtctgcattccttctagatggaagctgaaaagaagaatccatttcttttattttaaacttttattttaagttcaggggtacatgtacagttttgttacataggtaaacttgtgtcatgggggtttgttgtacagattatttcatcacccaggtgttaagcatagtacccactagttatttttcctgatcttctccctccttccatcctccatcctctgataggcatcagtgtgtcttgttc

SEQ ID NO: 39843 - DNA, 489 bp, Homo sapiens
  misc_feature 3: n = A,T,C or G
ganctgccgtgggtgtcggggcacagcttgtcctgagtcagaccctaatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggct

SEQ ID NO: 39844 - DNA, 365 bp, Homo sapiens
cctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttatttta

SEQ ID NO: 39845 - DNA, 242 bp, Homo sapiens
  misc_feature 1, 19, 43: n = A,T,C or G
ngccgggggcaggaggatnacttaagcctaggagttcaagacnagcctgggcaacatggagtaaaaccccatctctacaaaaaatacaaaaattagctgggtatggtaatgtgtgcctgtagtcccagctacttgggaggctgaggtaggtgaattgcttgagctgaggaggcagaaattgcagtgagccgagactgtgccactacactccggcctgggcaacaagtgagactctgtctcga

SEQ ID NO: 39846 - DNA, 473 bp, Homo sapiens
gtctgtatgcgtgcctgtctgtgtgcgggtgtgtgcatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatccacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaagggagatggaatgtgtctggtaaccccaaatggagtacaagtagcctttgttttcctgcataaatgga

SEQ ID NO: 39847 - DNA, 118 bp, Homo sapiens
atccagctaaactaagtcttcctaaatgaaggagaaatgagatcctttacagacaagcaaattctgaggtaattcattaccaccacatctgccttacaagagattttagaaaggagga

SEQ ID NO: 39848 - DNA, 163 bp, Homo sapiens
ctatatgtctatatttacatctataccacacatatttttgttctctagaagtttgatttgaatatacacacacacacatacacatgtgtgtgagaattaacagcagattagacattgcagaaaaaaattagttagcttgaagatatagcaatagaaactatct

SEQ ID NO: 39849 - DNA, 156 bp, Homo sapiens
gggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatcgt

SEQ ID NO: 39850 - DNA, 174 bp, Homo sapiens
  misc_feature 2, 8, 9, 22, 26: n = A,T,C or G
anaattcnntagaacttgcacntttntttgtatttagtattagtaacgtgagtggaatacaaccctcatttcttagagctggatttctccctgctgaataagtaattttttttgctcttcagagggtttgaattttggatatttagaaacaaagtatttctggtgagttttaca

SEQ ID NO: 39851 - DNA, 357 bp, Homo sapiens
caactccaaaggaaccctcaaaacctacaaatacatggaaattaaataatctgcttctgaatgatcattgggtaaacaatgaaatcaatatggaaattaaaaaattatttgaactgaataataatagtgacacaacctaccaaaacctttggggtacagcaaaagcagtgctaagaggacagttcataacattaaatgcctacatcaaaaagtctgaaagagcacaaatagacagtctagggtcacacctgatgtaactggagaaacaagaacaacccaaacccaatcccaggagaaaaaaagaaataacaaagatcaggagcagaatgaaatgaaattgaaacaaacaaatacaat

SEQ ID NO: 39852 - DNA, 466 bp, Homo sapiens
gtggggaagcgggggtgtctgattgacagttctgtcttgtggtctggcatggccctgtttgtagtgctgattgcaggggttgacttgctacagattgacataagctctacatatattaattccagaattctttgcattttatctcaattatattttattaaatatctatacatatgtgtaaaatatgtgcacgtacataatagaatcatctttcaggggtcgcactggcaagtcgcactgacttgctttgttttgaacaaaactttgattcattaggatcacaaaatcagtacattaacatttgaatgttcaaagaagaatttgatgttattctttctttctttagtcaaggcatgcctctttagcatttttacttggtggacatttatatcacttagactttgctcctgtattgtgtttttattttaactctgtaaggctttaaatctcttccatagagattgca

SEQ ID NO: 39853 - DNA, 495 bp, Homo sapiens
  misc_feature 2, 17: n = A,T,C or G
cncccgggaattcggcnttatggccgaggattgttgcaaggatagtgaagccttgggcaggctgctggggcccttggaaggtcgagataaagagaaacaatacacatttatagttctaagaggttatgcattatagaacaccttctccagtttaatataagaataagcagtctctgttctctaaaagccagaaggcttatgggggagaccaacacactaatttagggcttcagcagaaatttctgtaaagtgaggtgtgcctaccttccctttcatgtttccctaaatgatatgtcccctaccctgcagattgatatctgatgatgcaaaacaattaaacaaaaccctctctttgctgacctgtgaaatctgaagtttttacagtgaaaagtgctaaataaatgttcaaagttgacatagtatatttatcactttacacctaatggtctttctatgatgaattgacttaagtgctttgtactggagaatcagcac

SEQ ID NO: 39854 - DNA, 306 bp, Homo sapiens
gaacaacaccataggccaattaaacctaacagctgtatacagaaacacaccacacaatgaaagcggagttcacataaaacattctccaggctataaatatttacagctataatatattctcggtaaatgttaaaagattgaatttatgtttagtatcttatccaagtacagtggagtgaagatggaaataaataacagaaggaaaatgaaaattctcaaataaatgaaaattaaacaacatgctcttaaactaccaatgggtcaaaaaaagtcattagaaaaattagaatatacttggaaataaat

SEQ ID NO: 39855 - DNA, 473 bp, Homo sapiens
gtctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatca

SEQ ID NO: 39856 - DNA, 426 bp, Homo sapiens
  misc_feature 121, 415, 421: n = A,T,C or G
atacaagcagatgtggcagtatttgaagccgtgtccagcccaccgcctgccgacttgtgtcatgccctacgttggtataatcacatcaagtcttacgaaaaggaaaaggccagcctgccangagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgtcaagtcttccatcttactagatgtgaaaccttgggatgatgagacagatatggcgaaattagaggagtgcgtcagaagcattcaagcagacngcttantctgg

SEQ ID NO: 39857 - DNA, 386 bp, Homo sapiens
gaaaggaaaaccggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaata

SEQ ID NO: 39858 - DNA, 481 bp, Homo sapiens
  misc_feature 459, 460: n = A,T,C or G
gaagactcagtgggagaaggtggtatttaatttgagcgtttaaaaatgggtaggattttcacgagcagagattgagggagcaggatgaaaggggaggaagagtttttccaggctgcaaaccagcggagcagggtccaaaaggggaaagtgcagttgtcttattttctcctgcgcctgcgatctgcgggcaggtaagagccagtgggtcttctcccatctgaacctgtttgtgcccttgaggctctacttgaatccttatggctcctctgattttctgcaccatcagccagactgaggagaaatggctgttgatagctttaaagtgttaacactccgaaaagtatctctatattaactggtaagagcttaaagccttgaaccaaaagcgttagagttctaatagcttaaaggagaaaagccggtattgggttttaacaatatatttggtttatcaaatgnnggaaagccattgataaaattc

SEQ ID NO: 39859 - DNA, 231 bp, Homo sapiens
gtatgacaaacacacagccaacatcatatggaatggggaaaagttgaaagcattcttcctgacaactggaacaagacaaggatgtccactttcaccacttctattcaacatagtgaatcagacccataacaatcagacaagagaaagaaataaagggcatccaagaggaagtcaaactatcgctgtttgctgatgatatgattatatacctagaaaactctaaagattttt

SEQ ID NO: 39860 - DNA, 297 bp, Homo sapiens
aggaaattctatttttgttaattgtataaatatttttaatatagataagtataatgtgataaataaaagattttcaggcataaaaatgtgtcactgtaggacaaggtttcttaaccttatcaatagcactattgacattttgagtcagataattcttgttcttgggggctatcttcagctttgtaggatgtttaatagcatctgtggttcactggatgccagtagcacccttccttaagttgtgacaatcaaaaaatgtctccagacattgtcaaatgtccccctgataggtaaaat

SEQ ID NO: 39861 - DNA, 130 bp, Homo sapiens
  misc_feature 3, 12, 24: n = A,T,C or G
atnaaccttccntctacacttatnatcttcacaattctaattctactgactatcctagaaatcgctgtcgccttaatccaagcctacgttttcacacttctagtaagcctctacctgcacgacaacacat

SEQ ID NO: 39862 - DNA, 427 bp, Homo sapiens
catctgtaggtaccaacatcaaagacaaaaggtagataaaaccgcaaagatggggagaaaccagagcagaaatgttgaaaattctaaaaaccagagcacctcttctcctccaaaggatcgcagctccttgccagcaatggaacaaagctggatggagaaggactttgacaagttgacagaagtgggcttcaaaaggtcagtaataacaaacttctctgagctaaaggagcatgttcaaacccatcgcaaggaagctaaaaaccttgaaaaaaggctagatgaatggataactataataaacagtgtagagaagaccttaaatgacctgacggagctgaaaaccatggcacgagagcttcgtgacacatgcacaagcttcaatagctgattcgatcaagtggaagaaagggtatcaagtgattgaaga

SEQ ID NO: 39863 - DNA, 428 bp, Homo sapiens
atgaggttggagttcgaaagaagaagcaagcgctggcctggccttgaaagaaccgaagcctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttacgccttttatttttaatttaatcccgttcaattatttaattgttatacattgacattaactgctgtattttgactttgttcaataattttgttctttcagggctagaaataaacttttt

SEQ ID NO: 39864 - DNA, 483 bp, Homo sapiens
  misc_feature 2, 355: n = A,T,C or G
anaactaaacagaggaagtcttcagaagacctcgctttaaaacaaatttgtgcaaacactgctagagtccttttgaagctcaagcattttcactttgtttcttacactgtgtaccttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatggggnggttttcttttccgggtttggtggaaagtaatttgagaactttaaaggttgtctttttaactgctggcaaaatgttgattttttaatattagataaaacgagtaaacgaaattccccagaaattagta

SEQ ID NO: 39865 - DNA, 466 bp, Homo sapiens
catattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatatttgatgtctttgactgttggaaaccttgcagagcaagaatttgtaaccattgcacgtcactaccgtgtgcctg

SEQ ID NO: 39866 - DNA, 454 bp, Homo sapiens
catataacacatagtgtgggcttgtctactataccctgagacgataagattcttgaggactgggtcattatttataattacagatataaatttaaatctaaataaaactcactgcaatttttttcatagaagatacttcataaatgttgctgatatgaaaaattgaatctatgcccattgtttaattatcttcattgtcactgactaacttagtcttaccagcttaatacagtgtttatgaattatctcacagttcctgtggaccaggaatgtgggcacagcttagctggtacctctggctctagatctctcatgatgttgcagtcaagctgtcggctacaactgcagtcattcacagcccaactggggctgaagaggccacttccagattcagcctccacagagctgccttatgatttgggaaagctgtcttcctcatgaacaatcaatccta

SEQ ID NO: 39867 - DNA, 461 bp, Homo sapiens
  misc_feature 439: n = A,T,C or G
cccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgattagattggggggtgggnggggggtttattttctgaaagt

SEQ ID NO: 39868 - DNA, 418 bp, Homo sapiens
  misc_feature 13: n = A,T,C or G
gacaaccttagcnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacacta

SEQ ID NO: 39869 - DNA, 367 bp, Homo sapiens
gtccttagactaattatctctaatatattggtgttctgtaattttctttcaattgtgaagtatctacaggctgttgacaatcagctaaagaaaaaagcaagactgtttaaagacagtaacagggccaggcgcggtggctcacgtctgtaatcccagtactttgggaggccgaggtgggcaaatcacctgaggtcaggagttcaagaccagcctaggcaacatggtgaaaccctttctctattaaaaatacaagtaggccgggcttggtggctcatgcctgtaatcccagcactttgggaggccgagacaggcggatcacgaggtcaggagatcgagaccatggtgaaaccttgtctctactaaaaat

SEQ ID NO: 39870 - DNA, 463 bp, Homo sapiens
  misc_feature 463: n = A,T,C or G
gctttttttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggn

SEQ ID NO: 39871 - DNA, 468 bp, Homo sapiens
aatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaata

SEQ ID NO: 39872 - DNA, 261 bp, Homo sapiens
  misc_feature 187, 189, 218, 229, 251: n = A,T,C or G
gaagaattaggtcatccaaaatatgtgtggggtgtgaagttttgttttctgcacaaagacttgtcatgagtctaaacatttctctctcaagtaatttacaatttaattaccttgtgttatgttccctcaggaaggggaggagaagggaaaggaagaaaaggcaaaaaaaaaaaagttttaaaaatgngngctgcattcaggatttaaatttcaccttntaaagtttttnttacagcgtcctcctcccctcnttgggccatg

SEQ ID NO: 39873 - DNA, 417 bp, Homo sapiens
  misc_feature 69, 164, 172, 175, 208, 255: n = A,T,C or G
gtgaaaaagcttgtggtgaaggggggcaaaaaaaaaagaagcaagttctgaagttcactcttgattgcncccaccctgtagaagatggaatcatggatgctgccaattttgagcagtttttgcaagaaaggatcaaagtgaacggaaaagctgggaaccttggngggggggnggngaccatcgaaaggagcaagagcaagatcaccgngacatccgaggtatttgaaatatctcaccaaaaaatatttgaagaanaataatctacgtgactggttgcgcgtagttgctaacagcaaagagagttacgaattacgttacttccagattaaccaggacgaagaagagggaggaagacgaggattaaatttcatttatctggaaaattttgtattgagttcttgaataaaacttgggaac

SEQ ID NO: 39874 - DNA, 143 bp, Homo sapiens
agtggccactgtagtagacagggggatcagaagaggcctcttttgggaggtgacagttgagcctgataaccagaaagatgagaaggcaccagttgtgggaagatctgggagtggaacattctaatctaagcattgttacatac

SEQ ID NO: 39875 - DNA, 450 bp, Homo sapiens
  misc_feature 356: n = A,T,C or G
attgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgngggggtttctctctcccctcccttggtcttaattcttacatgcaggaacactcagcagacacacgtatgcgaagggccagagaagccagaccca

SEQ ID NO: 39876 - DNA, 124 bp, Homo sapiens
ctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 39877 - DNA, 287 bp, Homo sapiens
gaggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggaac

SEQ ID NO: 39878 - DNA, 476 bp, Homo sapiens
  misc_feature 16: n = A,T,C or G
gatgaccctgacaagncctcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagttctctcaaattttgccagtggaaacccttcaagtacttcatggcatggcctcatttgtctttttggtgcaacagggttgttacaagttgagttgaaaacaagaaaaacttgcttttggcgccatcaaaaaggaaggccagatactttcctttctacaattgaagccatttactactttctggtagactaccatactgatatattaaaagagaaatacagagggcaatatgacaatcttttatttttctattcttttatgtacccagttgataaagaatgccaaatgctctggagataaggaaacaggaaaac

SEQ ID NO: 39879 - DNA, 469 bp, Homo sapiens
  misc_feature 454: n = A,T,C or G
actcttatgggttgaatcgtgttttcttaaaatttgtatgttgaagttataattcccagtacctcagaatgtgattttatctggagataggatgtttacagaggtaatccagttaaaatgaggtcgccactgtgagtcctaattcaatatgactggtgtccttattaaaagggacacagagacacaaatggaaggaagacagtgtgaacagacacagggagaagatggccatctacaagccaaggagagggtcctggaataggtctttgccttacatgccccagaaggaaccgactatgccaacaccttgcttttggacttctaaactgcacaatagtgagacagttcatttctgttttttaagccaaccagtttatggtgctttatatggcagtgttagtaatccaatacagggagattctgagcagaggaaaccagagaaagaaagcctggntataggtttagaagg

SEQ ID NO: 39880 - DNA, 250 bp, Homo sapiens
  misc_feature 250: n = A,T,C or G
gtgtgaaattttaaaacaggttacattcatctatagtggtagagatctgaatagtggttaccttttgctggggctgttgcctgggaagaagcttgagggagccttctggggagctggaagtgttgaacatcttgatttgggtggtagttaccaaagatatacatattttaagaattcacccatctgtacacttaagatttatgtaaaatatactttaataaagacataacaaaactcaagggcaagtgcn

SEQ ID NO: 39881 - DNA, 269 bp, Homo sapiens
acccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 39882 - DNA, 352 bp, Homo sapiens
cgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctccgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatg

SEQ ID NO: 39883 - DNA, 148 bp, Homo sapiens
  misc_feature 70, 128, 136: n = A,T,C or G
acctcaaggatggctagaaatcttatatccgaccgcttacttcctgaacacagtggcatggaaacacatnatcatgatgtaatcatgagcctgtacataagccagctactctgttgggttcaggttgnaacctgantgtctgcagaat

SEQ ID NO: 39884 - DNA, 251 bp, Homo sapiens
  misc_feature 243: n = A,T,C or G
gagaacgggtcacgtgagcgcctcgcctggatgtgagtttcagccagatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaaggataccttcctttttggggaaaggtttggggtntttttggg

SEQ ID NO: 39885 - DNA, 383 bp, Homo sapiens
  misc_feature 46, 153, 154, 222: n = A,T,C or G
cacccagggaaattcggcgcttatggcgcgggattctcaacaagtnattccaagtcagcccgttaaggagaaagaaattaaggttagcgaatcatgtacaagctgagtgtgaaagtacgaaatcacctacaccagagagccattttggtattnngcctttaaataaaaagcctcctttatctggctgtgcagccttgctctgtggcttttcccaacacaatnagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatat

SEQ ID NO: 39886 - DNA, 470 bp, Homo sapiens
agaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttctttttaactgaaagctgaatccttc

SEQ ID NO: 39887 - DNA, 430 bp, Homo sapiens
  misc_feature 1, 29: n = A,T,C or G
natggacatgccatttaaaggtcccaggnagtattgatttccaactggaatgcaggaagagtctaagagtaactgaaatttggaaacactgctagttatttttaagactactctttcttgaaatggatcagaaccaatagaacaaaccacaggttgtgatagatttatgcactgaggaatataggaagagaaagtaaaaactatgggcaaggattttcataaactgcatcataaattgatttggtgggccccaaggagaacataaacactatgcccaaggactcagggatttgacttttgtttagatccattttataggcaatctgtaaaaggaaaaaagggcaaaaataatattagttatctcataaagttgtttaaaaatcaagtgatgagaataatctatttaaaatacttatcacagtgcctacac

SEQ ID NO: 39888 - DNA, 428 bp, Homo sapiens
aagaaatgcatttgtgtgttccttataacatcttacttaaaattcaaaggtaaagccagacactgtggcatatgcctgtagtcccagctgttcaggaagctgaggcaggagaatcacttgagccctggagtttgaggctgttgtgcactattatcatggtcgtgaatagtcactgcactgcagcctgggaaacacagcaagaccctgtctcttaaaaaaatgtttctcggtagttggtatagtggaacaagctgactacaaggacctttgtaatgctagagttgggagaatcagggtagcagtcttgtgctgactttaccattattgttaccaagggtctaaagaagctttttatccaatctgccacaaccacacacacccacaatgtaatacttaactgtaaggcagaattgggatgttacatttat

SEQ ID NO: 39889 - DNA, 144 bp, Homo sapiens
aatgtcattgctaaaaaataaataaaagctagatactggaaacctaactgcaatgtggatgttttacccacatgacttattatgcataaagccaaatttccagtttaagtaattgcctacaataaaaagaaattttgcctgcga

SEQ ID NO: 39890 - DNA, 213 bp, Homo sapiens
cccaggagttcgagacaagcctgggcaacatagtgggaactcatctctgcaaaaaatttaaaaactagctaggtatggtgatgcacacctgtggtcccagctactcaggagactgaggtgggaggatcacttcggcccagaacatcaaggctgcagtgagctatgattatgccactgcaccccagactgggtgacaaagtgagactgtgtctc

SEQ ID NO: 39891 - DNA, 464 bp, Homo sapiens
gacaactcggtggtggccactgcgcagaccagacttcgctcgtactcgtgcgcctcgcttcgcttttcctccgcaaccatgtctgacaaacccgatatggctgagatcgaggaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagt

SEQ ID NO: 39892 - DNA, 472 bp, Homo sapiens
  misc_feature 424: n = A,T,C or G
agaaaaaaagattcttcctaattaacataagtggttcctaacgagagcaatttttccacccaaaagtcatttggcaacatctacagacaattttgattgtcacactgggtcgggtaggaaggtatgctgcagacatttggtgggtagaggccatggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcaagnagtggggctggatcaagggcaaaaactggtcattaagtcatctgacat

SEQ ID NO: 39893 - DNA, 472 bp, Homo sapiens
gagagtgttatttatccgtagcctggccaatttcaggcaagtaattgcaggatgaggagtaattccagtccctgtacctgctggtgagatcactgaagaactcactcagcgtttgtagcacacagaatggccacggttacatacctgagtgcattcacagtataaccaagcccaaatcctcggccaaatccctaagggaatctgggttttaccttgcaaactttggctgctaggcacagttacagagccttgttatgctttaggctctcaataaaaatgtttgccctgggttattacaaagactttcttggtacagaaattcagacaagatcacgaagcacagggtgaaaatacaggaatgagcagaaggagccaattctaaagttttctgaagtcagctcatgccttcataaatagtgagcctccttggtcgctcactgaaacaaaaaagatggacatgtaatttacctag

SEQ ID NO: 39894 - DNA, 439 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgccacagaaccctctaaatccccttgtaaatttaactgttagtccaaagaggaacagctctttggacactaggaaaaaaccttgtagagagagt

SEQ ID NO: 39895 - DNA, 471 bp, Homo sapiens
  misc_feature 435, 450: n = A,T,C or G
catcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttanatacaaacttatttncatgtttctgaatcttctttg

SEQ ID NO: 39896 - DNA, 479 bp, Homo sapiens
  misc_feature 5: n = A,T,C or G
acccngggaattcggccttacggccttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactccgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacg

SEQ ID NO: 39897 - DNA, 459 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccca

SEQ ID NO: 39898 - DNA, 301 bp, Homo sapiens
aatctaaattaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgc

SEQ ID NO: 39899 - DNA, 466 bp, Homo sapiens
gaatgggggaggggacagtggacagagctttgatgtccacttgtgtgcacagagctctttaaagctctgtgttagagcaggaggtgagaagagaatgggtggtcttagggctcaggaattagggatcagctctccctttgctgtatgaacctctgaagaatctgagaatttaaatataaatcttgcctgccaggcttttatgatgatgtatttgtcaaaacagaagtatagaatatcttttatataacagtttgttttcttgatttacagcgtttaaatatttaggtgtgtggtgggtgggcctccatttggacttttgccccaggccttgcaagctagggcacaggcctgaagctacgtaaatgcacctgagagagatttttagtttgtaaaggacagattttaaagaaatttgttcaagagaagaaagcgaagtttcctggctcatgggaacatctgtagacat

SEQ ID NO: 39900 - DNA, 451 bp, Homo sapiens
atgcacactccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggggcaaccacatgggcacccttgttcataccaaagggtgagcagtggccaggagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagcccttcttaaatgacaaaatgc

SEQ ID NO: 39901 - DNA, 474 bp, Homo sapiens
  misc_feature 468: n = A,T,C or G
tagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggngttggt

SEQ ID NO: 39902 - DNA, 473 bp, Homo sapiens
cacttgattgagagaaggattggagaggagctaataagtgaagttttgtttttgccatttaggaggccacagatgaaaaactaaatgcaacactgtcgcatatgttgctgtgcaacaaacaattaaatagaaaatgagatgcatataaaaaagccttttcttacagaaggcaggtacactctcaaatcagaaaccatgggatatttcgaaatttagaacagggacaatgtcgagagtattttaaatataggcagcaggtagaacatccaaaagttgatggacacatgctccagttacttacatgcaacaggaaagtgtgaggctataggtggtctgcagaagggttgctaaggcttgttctacaacagatgataacagaggaggtggcagtgaatgaggaatgacaccagcctgccacatgtgccaaaagcaggatgcatgggtggcaaggtgggagaagataaaccacacca

SEQ ID NO: 39903 - DNA, 469 bp, Homo sapiens
atcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatccggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatg

SEQ ID NO: 39904 - DNA, 334 bp, Homo sapiens
  misc_feature 22: n = A,T,C or G
aatacatgtgtagttccaaagncacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttataga

SEQ ID NO: 39905 - DNA, 471 bp, Homo sapiens
aacagtagtacagatacctattactagaggagaagtaatggtgagaaacttcttggtgtgactccattattcacacaccattcttgtttgccctgacgtgttatgcaggtctggcttttatttgagatgtcctgaccttatataagagataggactgattcaagtttcaagcctaatgatgtaacacctctcagctggaagggagcatctctgagattgattcctacactgtgggagttccaagtatatattcatcacatataataaacttcctaagtcccagaatccctttcgccaccttttgctagcttttataggacagttttttagtaagttatttcttaatcagtgtcttatcatttccaggtagtaagtttagactcattaagcctttgaagttactggtgctattaagtgcatcattgctctgtgcattgaaggacagtgaagtggtggctgcttgtctgtgtg

SEQ ID NO: 39906 - DNA, 153 bp, Homo sapiens
cattttctttgataggtcagaattggaacatttaactattagtaaaaattgggattgtagtgtggttttacgtaagcaaacaactcttactctattttatttacaaaaattaataacaaaaataaatgcccaaggtagagggaattaaatact

SEQ ID NO: 39907 - DNA, 181 bp, Homo sapiens
agtttgagatagactgggcaacaactgagaccctgtctctacaaaaaatttattaaaaattagccaggtatggtagtgcacgctggctgaggtgggaggatcacttgagcctgggaagacttcagtgagccatggttgtgccactgccctctagcccaagcaacagagcaagaccctgtct

SEQ ID NO: 39908 - DNA, 185 bp, Homo sapiens
  misc_feature 5, 81, 105, 113, 134, 160: n = A,T,C or G
gaagngagtacatgaacggtgctaaaaatgaaaattctaacccaaggacatgacattcttagctggaacttaactattaangccttttccacacgcattaatagncccatttntctcttgccatttgtaagctntgcccattgccttattggcacatggntggacacggatctgctgggctctgc

SEQ ID NO: 39909 - DNA, 474 bp, Homo sapiens
atagatttaatgccatccccatcaagctaccaatgagtttcttcatagaactggaaaaaactactttaaagttcatatggaaccaaaaaagagccctcattgccaagacaatcctaaggcaaaagaacaaagctggaggcatcacgctacctgacttcaaactatactacaagtctacagtaaccaaaacagcatagtactggtaccaaaacagagatacagaccaatggaacagaacaaagccctcagaaatagtaccacacatctacaaccatctgatctttgacagacctgacaaaaacaagaaacggggaaaggattccatatttaataaatggtgctgggaaaattggctagccatatgtggaaagctgaaacgggatcccttccttacaccttataaaaaaattaattcaagaggggttaaagacttaaatcttagacttaaaaccataaaaactctagaagaaaagc

SEQ ID NO: 39910 - DNA, 470 bp, Homo sapiens
gagagatttgcttccagctcactcttgtgactattggcctgagatgtcagttgccacatgggactccccatagggcagctggattctctcagagcaggagggtacctaaaataacaccatggtcttttcgtaacctaatctcagaaatgacagccaatcactgttgctgcattctatttactggaagtgagtcactaagtccagcccacgtacaaagggaggagactgcacaaggaagcagtcattggacatcatcttagagaaggcccaccatggtaaatgtatttccttaaactgagtatataaaaatattattttaacatgtagtcagcatacaataattaccaatagatatttaataccttttactaagtctatggaatatagtgtgtattttacacttatagcacttctcaactcagatgttatattttcattggaaatacccgatctgtatttagatgtcatga

SEQ ID NO: 39911 - DNA, 283 bp, Homo sapiens
  misc_feature 283: n = A,T,C or G
atgatgaaattccctgcatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcggtttcattcagctctctatggaccagtaatctgataaataaccgagctcttctttggggatcaatatttattgacttgtagtaactgccaccaataaagcagtctttaccacan

SEQ ID NO: 39912 - DNA, 482 bp, Homo sapiens
attaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgttttt

SEQ ID NO: 39913 - DNA, 336 bp, Homo sapiens
actgaaatactttcttgccttggcttccaaaatgttacatttgcctggtttttctcctacctcactggctgctttttctcactcttatctgtatatttacctcatcttcctcttctttctcctcctcattcttattttcttccaccacgcccggctaattttttgtatttttagtagagacggggtttcacagtgttagccaggatggtctctatctcctgacctcgtgatccacctgcctcggcctcccaaagtgctgggattacaggcgtgagccactgtgcccggcctatgttggtgattattaatggtaaggaaaaattttagaaggtcctg

SEQ ID NO: 39914 - DNA, 343 bp, Homo sapiens
tcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactc

SEQ ID NO: 39915 - DNA, 314 bp, Homo sapiens
cacattggccaagttatcatgtccatccgcaccaagctgcagaacaaggagcatgtgattgaggccctgcgtagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgt

SEQ ID NO: 39916 - DNA, 159 bp, Homo sapiens
cagggtggaatagacagggatagaaactaaaattctttgagtgtgcctgttttatagaattactttgaaatcaggtatatgttttacttaattaaaaattaaaaaggaaatacaaatacaatctcttgaaagaaagaaaaaaaagggagagggttggag

SEQ ID NO: 39917 - DNA, 351 bp, Homo sapiens
atctttacttggaagttttctttttttaattgcagaagaaataagaattcactcctataaaaatttagatgatgcagctgggcgtggtggctcacgcctgtaatcccagcactttggaaggctgaggcgggtggatcacctcagctcgggagtttgagaccagccggactaacatggtgaaaccctgtctctacaaaaattagccgggcgtagtgatgcatgcctgtaatttccagcgactcgggaggctgaggcaggagaattgcttgaacccaggaggcataggttgcagtgagctgaagtcacaccatggcactccagcctgggcaacaagagcgaaactatgtctca

SEQ ID NO: 39918 - DNA, 405 bp, Homo sapiens
  misc_feature 354: n = A,T,C or G
atgtttttttttgtcttgcaaatgttctatgttttgagatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtattttttttttcttctggacagtntttaaaggatcttattcttatttcccagggaaattctgggctcccacaaag

SEQ ID NO: 39919 - DNA, 162 bp, Homo sapiens
atctcatgacatggtgaggcctaatgcagagccatgcagctgggcaccgtggctcacacctgtaatcctagcactttgggaggccaaggtgggagcgttgcttgaaaccaggagttaataaaggtcaacttgggaaatataatagtgagaccccatctctat

SEQ ID NO: 39920 - DNA, 466 bp, Homo sapiens
tcctccaagtagtttggggcgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgactcattctcatttacttaattgaggagtaggagactaaaagaatgttcactctttgaatttcctggataagagttct

SEQ ID NO: 39921 - DNA, 135 bp, Homo sapiens
  misc_feature 26, 101: n = A,T,C or G
accaatgacataaatacatacaagcncacacaactaaaatgtcatgttattaacagttattaggttgtcatttaaaaataaagttcctttatatttctgtnccatcaggaaaactgaaggatatggggaatcatt

SEQ ID NO: 39922 - DNA, 214 bp, Homo sapiens
catgttcacttgttgttttaccccatctactctaacttcgttggaagccttgtctagagtatagtatgtgtttttacctttgcagtgaattgcatgtgctaattgtaaccacagctatttttatgttgacataactccaagtgttatattaaatgttctattttatattagctctaatcccttaagtaaattttaagaaataaattcttgttca

SEQ ID NO: 39923 - DNA, 413 bp, Homo sapiens
caccacatacattctttacatattatttatggctgcctgtgtgctacaacagcagcgctgagtcaccgtgacagagaccgtatgacctgcagagcctgagatatttactacatctgttccaccatagaaaaggtttgccaacccgactggctgcggtgactcatgcctgtaatcccagagctttgggggatcatctgaggtcagcagttcaagaccagcctggccaacatgttgaaaccctgtctctactgaaaatacaaaaattagctgggcgtggtgttgggtgcctgtaatcctagctactcaggaggctgaggcaggagaattgcttgaacccaagaggcggaggttgcagtgagccaagattgtaccattgcactccagcctgggtgacagagcaagactccgtctca

SEQ ID NO: 39924 - DNA, 284 bp, Homo sapiens
gcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 39925 - DNA, 123 bp, Homo sapiens
tgaccacgggtgacggggaatcagggttcgattccggagagggagcctgagaaacggctaccacatccaaggtaggcagcaggcgcgcaaattacccactcccgacccggggaggtagtgacg

SEQ ID NO: 39926 - DNA, 468 bp, Homo sapiens
  misc_feature 457: n = A,T,C or G
atgttttaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagccctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaaagagttctttatatattctggattctagacccttatcagatacatggtttgcaaatattttctcccattctgtgggttgnggttttcactt

SEQ ID NO: 39927 - DNA, 390 bp, Homo sapiens
ctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttg

SEQ ID NO: 39928 - DNA, 104 bp, Homo sapiens
gattaaatgagttaatatgtgtaaccatcttaacacctggtatatggaaggatcttaaatgttagctagtattatgatcttattaaccctattgaataattatt

SEQ ID NO: 39929 - DNA, 176 bp, Homo sapiens
  misc_feature 154, 160, 164: n = A,T,C or G
agaaggagatagctaaagatgtgtatttagagctcctggttgggtaacttcctgttatcgtgatcttagcagaagctgttcatcttggactttggtgttttacaaaatgagaaaagggcatgattcaattcagtctggaggtattgtttgtaancagtantttnggtgtttttgtt

SEQ ID NO: 39930 - DNA, 471 bp, Homo sapiens
tctgcttgtctttcttgagctttttggaaggataattctgataaggcactcaagaaacgcacaaccacagtgctttcttcaaatcatatgagaaatactatgcatagcaaggagatgcagagccgccaggaaaattttgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgta

SEQ ID NO: 39931 - DNA, 475 bp, Homo sapiens
ctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgaatgagcagacctttatgtattatgtgaatgatggcgtctatggatcatttaattgcatactctatgaccacgcacatgtaaagccccttctgcaaaagagacctgaaccagatgagaagtattattcatccagcatatggggaccaacatgtgatggcctcgatcggattgttgagcgctgtgacctgcctgaaatgcatgtgggtgattggat

SEQ ID NO: 39932 - DNA, 468 bp, Homo sapiens
caaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagagagctcagaaggctaaatgaatattatccctaatacctgccaccccact

SEQ ID NO: 39933 - DNA, 467 bp, Homo sapiens
gagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgttttttttctgctttgttttttcagtttgc

SEQ ID NO: 39934 - DNA, 474 bp, Homo sapiens
atatgaaaacagtgcagtaagttgaaaactcagtatctatggaattgataaatgttgatctggtgtagtatattttatcgcattttcttatattaaaaaatgtctgcatgattacattttatttcctttgtaatttacgtttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgtt

SEQ ID NO: 39935 - DNA, 220 bp, Homo sapiens; identical to SEQ ID NO: 38012
  misc_feature 218: n = A,T,C or G

SEQ ID NO: 39936 - DNA, 465 bp, Homo sapiens
  misc_feature 13: n = A,T,C or G
gattttaaaaatnttgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgct

SEQ ID NO: 39937 - DNA, 330 bp, Homo sapiens
ctaatacagaagggtatttcagaaatagggaacagcatgagcaaaggggctgtggcttattttggggatattctaggaacaacaagtggctggcttatggagggggctaaagatgaggacaaaaggtatgttgggtacctagaaagaacctttcatgccatgctaaggacaccttgttcttctgccatcagagactgcactagaattgttggcttgactgagttagactataagctccttgagggtaggtgatgggtgcaccaaaatctcggaaatccccactaaagaacttatccacgcaaccaaaaccacttgctcccaaaactattg

SEQ ID NO: 39938 - DNA, 146 bp, Homo sapiens
  misc_feature 145: n = A,T,C or G
cagtgacagaggtgttttggttttattgttatgtgggttttcttttgtatttttttttgtttgttttgtttttaaacattcaaaagcaattaatgatcagacataggagaaaccctgaatagaaacaaaacttttgaatgctggnt

SEQ ID NO: 39939 - DNA, 263 bp, Homo sapiens
catcacactacctgacttcaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatac

SEQ ID NO: 39940 - DNA, 259 bp, Homo sapiens
cacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaag

SEQ ID NO: 39941 - DNA, 302 bp, Homo sapiens
  misc_feature 246, 270: n = A,T,C or G
gattaataaaaaaggcagatattttcagaatttgaatttcagtttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgngacagtttgaaaccttcacagttntcctctgggggtaaatcaattcttcaaccctt

SEQ ID NO: 39942 - DNA, 324 bp, Homo sapiens
agcctagtagctccactgggttactagacccagaagagcaaaaacaatcactacagtttggctctcaggaatacccattcctaggggaagtgggagaacaccacatcaagggaacacccagtgggacaaaataatttaaacagtagtccttgaatcccagatcttccctctgacatagcctacccaaatgagaaagaaccagaaaaacaattctggtaatatgacaaaacaaggttatttaacacccccaaaatataccagctcaccagcaatggatgcaaaccaagatgaagtctatgaattgccagaaaaagaaatcaaaac

SEQ ID NO: 39943 - DNA, 468 bp, Homo sapiens
atcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtg

SEQ ID NO: 39944 - DNA, 470 bp, Homo sapiens
gttgaagtcttttatatcctcactgcttttctgtttagattttctgtcaattattgagaatggggtattgaaatctttaaatattgttgaattgttatttgttcttttaattctttcaggttttgctttatgtatttgagagtgctcttgttaggtatgtatagatttataattgctatgtggtcctgactgtatactgtactgttgggtttataacagaaaatacatgtacaagtcaatatcacttaagaaaatccttcatgaagcagtaaatatgtataaatatatatattttaaaagagaaagaggaaggaaggaaatggaattatatcgaaacaaagtttctgtattttaccgaattaaataagtataaatccagaatagattgtgatgagtcacaatggacattctaattgttacactaactgctaagaaaataagccagtaaaatatgcttaaaatcaatagag

SEQ ID NO: 39945 - DNA, 163 bp, Homo sapiens; identical to SEQ ID NO: 36062

SEQ ID NO: 39946 - DNA, 196 bp, Homo sapiens
gagctagtatgatgctttttagtatgcaaaatccctattcctatgaagagtcattattcaaaaaacactacttaaatttgtaagttttttatataaaagtagaatttaggagtaagaaatacggaattagccaaagcaggaagatcacttgagaaattcaagaccagcctgggcaacatagcaagaccctgtcttc

SEQ ID NO: 39947 - DNA, 151 bp, Homo sapiens
gtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgc

SEQ ID NO: 39948 - DNA, 476 bp, Homo sapiens
  misc_feature 181: n = A,T,C or G
gagaagggaggtggtcgccctccgtcgtggtctggcgtgtattccgagcgttggtgtctggcggtttccgagcgttggtgtctggcggtttctgaccgttggtgtctggcggtttccgaccgttggtgtctggcacgcgccaccctctcttgctttggttgcgccatgccgatgtaccagnacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccg

SEQ ID NO: 39949 - DNA, 151 bp, Homo sapiens
  misc_feature 21: n = A,T,C or G
cttgtcccgcctcatcccagnaagggaggatgggcgatgacagttgtttctatgccttctgacccagtttcccagtttataactttatgacaatgagtttctcaagcccaaggccttatcttcaccccacaaacaataaagcaaagtaaag

SEQ ID NO: 39950 - DNA, 299 bp, Homo sapiens
caaatgatttttgttcctttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatcttcctttagaaaactggtgttttctaaagaaacaggataggagtttagagaaggcaccaaagcattcactttggtttg

SEQ ID NO: 39951 - DNA, 395 bp, Homo sapiens
  misc_feature 4: n = A,T,C or G
agangcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtggccaatgcattaccttctgttccttatgatattctcattatttcatcatgactgaaagaagacacgagcgaatgatttaaatagaacttgattgttgagacgccttgctaga

SEQ ID NO: 39952 - DNA, 352 bp, Homo sapiens
  misc_feature 6, 33: n = A,T,C or G
gctttnagaattaacgaaagcagtgtcaagacngtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctaga

SEQ ID NO: 39953 - DNA, 237 bp, Homo sapiens
  misc_feature 31, 184, 237: n = A,T,C or G
ggaggcggaggggaagatggtcagtaggacntaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaaagaaagcctacaagnaagtacattcaaaagattacattgaaattcaatcaaaggggaaactttgaaan

SEQ ID NO: 39954 - DNA, 444 bp, Homo sapiens
gagagatggagatgaaattaaaatgtgacttctttggcatccacctttcgaacctaggccttccccactttactctaattcaatttagtagatgttggatggaaactaatacagttaaaaagaacttcatgtaatctcactaacattcttagaacatgatgctcaaggttttctggtcaaggatatttgcatttgcatttatagaatagttaagagccagaattctatgcatgtgagaagtccttgctttgagaatgacatttccaagctgtcaaaatctaatgtgctcaaagctcaaaccaaaattgctttttattctgtaaatattgaagagaaggcttagagtggcaccagtgaagttgctagccagggtactagcctactgagttggaatcagaaaaagtccatttgttgagtttaaattataatacaatccaagcctga

SEQ ID NO: 39955 - DNA, 412 bp, Homo sapiens
  misc_feature 6, 21, 32: n = A,T,C or G
gatctngtcttgttcccgaanaagtagaagcntcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagaaaatcaagtatattttaaaagaagggatgtgggatcaaggaggacagccttggcagtagtggcccttgaaccagcaacaatggatgcagtcattccagcaccaacaggatccaagccagattgattgggctgcattggcccaagcttggattgcccaaagagaagcttcaggacagcaaagcatggtagaacaaccaccagggatgatgccaaatggacaagatatgtctacaatg

SEQ ID NO: 39956 - DNA, 170 bp, Homo sapiens
  misc_feature 7, 32: n = A,T,C or G
aagagangttaggattttattgttcttatttncctttacagttctgcagttccatcacagtatttttttaaataactcaggtgtatgagaagaaattagaaaagaaaattaacttatgtggactgtaaatgttttatttgtaagattctataaataaagctatattctgt

SEQ ID NO: 39957 - DNA, 413 bp, Homo sapiens
attcatttaaggtacaaaattctttggacatctactatgctctgcacacaaggccagaaacagaagaataaacatagtatattatatgttgcttacagtttttaggagatagatgaacagacaattacaagacagagtctttagtgataaaagtatgcctagatgagcatactttttgccaaatgggcagagactatgcctagttttcaaagattcattttgtttaatttgcagatttcctacagtaacttaaatataaattttctataattggctttattcagaagggtaaccaaattgccagacttttaaattgcccagtaaataaatgaggacacaacaggaagatattactaggagtttttaatgaggaataattttttatattttatgcactttctaaagtattatgc

SEQ ID NO: 39958 - DNA, 401 bp, Homo sapiens
  misc_feature 6: n = A,T,C or G
catggncgtatatgtaccacattttctttaaccgtctaccattgctgggcattaaggttgattccatgtctttaccagtatgagtagtgctgcagtgaacatgtgcatccatgtgtctttatgatagaatgatttatattcctttgggtgttgtattagtctgttttcatactgctataaagaattctcctagactgggtaattcataaaggcaagagatttaattgacacacagttctgcattgctagggaagcctcaggaaacttacaatcatggcagaatgcaaaggagaagcaggcacgttcttcacagggcagctggatggaagtgagtgcaagcaggggaaatgccagagacgtataaaaccgtcagatctcaggccaggtgcagtggctcatgc

SEQ ID NO: 39959 - DNA, 335 bp, Homo sapiens
  misc_feature 21, 319, 334: n = A,T,C or G
atctcaaatattctgttaacnaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttnaaaaaaaagtttttnc

SEQ ID NO: 39960 - DNA, 334 bp, Homo sapiens
  misc_feature 55, 61, 148, 151, 290, 313: n = A,T,C or G
atagacattctcacataagcccagttcatcaccatttcctcctttacctttcagngcagtntcttttcacattaggctgttggttcaaacttttgggagcacggactgtcagttctctgggaagtggacagcgcatcctgcagggctnctnctcctctgtcttttggagagccagggctcttctcaggggctctagggactgccaggctgtttcagccaggaaggccaaaatcaagagtgagatgtagaaagttgtaaaatagaaaaagtggagttggtgaatcggttgntctttcctcacatttggatgatnggtcataaggtttttagcatg

SEQ ID NO: 39961 - DNA, 102 bp, Homo sapiens
aggatagccgttctgcaaaaatatttataaaacttctcaagatactgctactgtaattttatatgaagataagtgtatttttcaataaagcatttataaatt

SEQ ID NO: 39962 - DNA, 484 bp, Homo sapiens
  misc_feature 17: n = A,T,C or G
tatggccgggctacctncaaaatatatacagtattttgactacttctcacagtgagaagtagatattgttactcccctagtaggagaacttcatcagctctcacttcctttactctaataacatcctggctggtctcccggcatccaccctttgccccctggggtctattctcaacccagtagccagagtgaacctttcaaagtagatgtcagatcgtattactcctgtgctcagaatcttccagcggttccccatttcccgcagaggaggcattaaagcgtgtggttcttcattttatccaaagtaaaaggcagattctttactgaggccttcaaggtactgcatgagttggctgttctttttatttcccaggcctccttttttctactctctccctggccactctgtctccagtcacatttttttcccttgctgttccatgaactcacaaggccacacttccaccatagggctttgcctaga

SEQ ID NO: 39963 - DNA, 378 bp, Homo sapiens
  misc_feature 32: n = A,T,C or G
gtggagcaactggagctgggcctcaagagctnaaacccaccccgaaacagaaagagcaggctattggagcaatccgaaccctgcgcagcaaaagcacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtg

SEQ ID NO: 39964 - DNA, 438 bp, Homo sapiens
  misc_feature 31, 409, 425: n = A,T,C or G
atctgccaaaaatgtcactttgcctgctgtnttcaaggctcctattcgaccagatattgtgaactttgttcacaccaacttgcgcaaaaacaacagacagccctatgctgtcagtgaattagcaggtcatcaggctagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaagggtcatcgtattgaaggaagttcctgaacttcctttggnagttgaagataaagtngaaggctacaaga

SEQ ID NO: 39965 - DNA, 482 bp, Homo sapiens
acctgtgcagagaacaaccctattctgattagaaagatcctgcctgagaaccttttagcttcacagcaggatgtgtacaaccgaagtcgattcaagaaactcatgacgtcatccctcagtcaataatcattgattgaatagagttggtttcagatgtaggtattaggtaccagtagggatacagaaggaaaattcgtggtttccgtctttgaagaataatctggttcagaaaatagttcaaatgtgcatgttttgacatggcttcataacaaaagatcctttcaatcaaaatgctagggaaaccagcattaaaggagagattgtggggcaggcgaggtattggcagcagggacatgggttgtcaggagacaatggaacagaaacaagacatgagaaaaagtgcgagcttaatccataaagctgtttccctccaaaggtgtcagctgcatggcgtgggaggtcaggcaagtgggtctgtgttc

SEQ ID NO: 39966 - DNA, 355 bp, Homo sapiens
  misc_feature 351: n = A,T,C or G
tatggccgggagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaatatatgtgattgttccataataaacttctggngtga

SEQ ID NO: 39967 - DNA, 151 bp, Homo sapiens
cagttatttgtgagggtgtttattctatatgaatattgtttcatgtttgtatgggaaaattgtagcgaaacatttcattgtccccagtctgcaaaagaagcacaattctattgctttgtcttgcttatagtcattaaatcattacttttac

SEQ ID NO: 39968 - DNA, 428 bp, Homo sapiens
gattttattttgcacgtaacaaaaatgaaaaattgaggcacagaattcaagctttgcagaaaaatgtgttggctccctaaccaacacacacacacacgcctactttcccaaattctttcctcctgtatgaaaaaacttaaggctgggcacagtggctcatgcttgtaatccagcactttgggaggctgaggcagcaggattgcttgatccaaagaatccaagaccagcctgggcaacatgatgagaccctgcctctacaaaaagaaaaggaggaaaaaattagctgagcatgccaatagtccctgctactagggaggctgaggtgagaggattgcttgagcccaggaggtcaaggcggcagtgagccgtaatccagccactacactctagcctgaatgacagagcaagactctgtctcaaaaatgagc

SEQ ID NO: 39969 - DNA, 415 bp, Homo sapiens
  misc_feature 32, 361: n = A,T,C or G
gcttttcgatccgcctctgcggtggagccgcnaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggnggatgagaatggcaaaattagtcgccttcgtcgagagtgcccttctgatgaatg

SEQ ID NO: 39970 - DNA, 465 bp, Homo sapiens
  misc_feature 7, 24, 34: n = A,T,C or G
gagagangttgagaacaacccagnaaaccttcanctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagggtgacattattttattataac

SEQ ID NO: 39971 - DNA, 337 bp, Homo sapiens
attctttgacagcctctccctactccaagatttaaaaatgtttacttttgtatttaaagttttgatcaatctggaattttttttgttatgagaggatctatcttcacttttttctaagatggctgcccattcatcttttccctactgagaaacaatatcgtattctaaattctcatatgtctttgtgtcatatttgggcttcctcttctttttcattgatttgcctattcttgtttttattttattttattttattttattttattttattttattttattttattttattttatttttgagacggagcctgggcgacagagtgagaccctgtctca

SEQ ID NO: 39972 - DNA, 196 bp, Homo sapiens
aagactggttaatgataacaatgcctcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 39973 - DNA, 197 bp, Homo sapiens
  misc_feature 33: n = A,T,C or G
caggcatatttttcagaagtattccagaagaangcattgttatcataggagaccacaggggggtctcatagcccctgaagaccttccagtgagataagatgctgaggtggcagatggtggtattgaagattctggccccgtgtagtccctgtgtgtttgtttcttagtgtttaacaaaaatgtataaaaagttttga

SEQ ID NO: 39974 - DNA, 262 bp, Homo sapiens
aagaacgattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagttttt

SEQ ID NO: 39975 - DNA, 484 bp, Homo sapiens
caggaaaaataagaactcaatgaagttgtgacttcattcaaatcacgtagtttatatacatgctattagtaaaacccaggacagctgagtacaagttttacccttatattcacattgaggtccagatcctggttttgaatgagataattacgtgcagtcggactgttttctgatcctaaaaatagagacaataatatctatcttgtaaagttatggtagtgttaaagatatataaaatgttggcaagtaccttaatatacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattg

SEQ ID NO: 39976 - DNA, 465 bp, Homo sapiens
  misc_feature 15: n = A,T,C or G
ggcccacccctgatnaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtca

SEQ ID NO: 39977 - DNA, 471 bp, Homo sapiens
  misc_feature 33: n = A,T,C or G
ggcagtccggcggtcccgcgggtctgtctcttncttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccactttcttccgcgaactggccgaggagaagcgcgagggctacgagcgtctcctgaagatgcaaaaccagcgtggcggccgcgctctcttccaggacatcaagaagccagctgaagatgaagtg

SEQ ID NO: 39978 - DNA, 490 bp, Homo sapiens
  misc_feature 31: n = A,T,C or G
ggctgcggaaaaattccgttccatccttctnattgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgtcacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactc

SEQ ID NO: 39979 - DNA, 179 bp, Homo sapiens
  misc_feature 16, 35, 44: n = A,T,C or G
aaggccggggggaaanaaggcagcagctaccaagnaaaccagcncctgaaaagaagcctgcagagaagaaacctactacagaggagaagaagcctgctgcataaactcttaaatttgattattccataaaggtcaaatcattttggacagcttcttttgaataaagacctgattataca

SEQ ID NO: 39980 - DNA, 468 bp, Homo sapiens
agtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattacccccactgtcaacccaaca

SEQ ID NO: 39981 - DNA, 466 bp, Homo sapiens
atcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgca

SEQ ID NO: 39982 - DNA, 222 bp, Homo sapiens
  misc_feature 7, 35: n = A,T,C or G
aacccangcaacagaaaactaaacatcacatgttntcacccataagtgggagttgaacaatgagaacatgtggacacagggaggggaccatcacacaccagggcctgttgttgggtgaggggtgaagggagggaacttagaggatgggtcaataggtgcagcaaaccaccatggcacatgtatacctatgtaacaaacctgcacgttctgcacatggatcct

SEQ ID NO: 39983 - DNA, 441 bp, Homo sapiens
  misc_feature 36, 208, 212, 364: n = A,T,C or G
caatatcagaagtaaaaccaaacatacttcttattnacccagtttctctctctctctctctctctcgaaattataaaaacaattaatgcatcctgacccttggaaatgcctcccagccctttaaacaaaatgcaggtttggtgcctgcctgacgattagttttagttaactgaaaattataggattgacccaagaggaaaactttgtntgcnctccaatcacttttacaaattaaggaaaattaccacaattttgtttagctaaggtttcacactgagttcaagaaattagctcagccatcccaacaaagtcagcactttgttagtgagcacttgaaaaaataatagtctttctggagttttgnggtgtatacaaacgaagcgtagagaaagctatgatgctttatagaagtaggccaagtgtttttaattaggctcattg

SEQ ID NO: 39984 - DNA, 139 bp, Homo sapiens
ggcgcactagatatagtaccgcaagggaaagtatgaaaaattataaccaagcataatatagcaaggactaacccctataccttctgcataatgaattaactagaaataactttgcaaggagagccaaagctaagaccct

SEQ ID NO: 39985 - DNA, 107 bp, Homo sapiens
  misc_feature 7: n = A,T,C or G
gtgaaanttaaataatagacatacaggagatatacaaatatattatatatttttctgagatttttgatatctcaatctgcagccattcttcaggtcgtagcatttgg

SEQ ID NO: 39986 - DNA, 186 bp, Homo sapiens
cacccataagtgggagttgaacaatgagaacatgtggacacagggaggggaccatcacacaccagggcctgttgttgggtgaggggtgaagggagggaacttagaggatgggtcaataggtgcagcaaaccaccatggcacatgtatacctatgtaacaaacctgcacgttctgcacatggatcct

SEQ ID NO: 39987 - DNA, 148 bp, Homo sapiens
  misc_feature 7, 8, 34, 142: n = A,T,C or G
caatatnngaagtaaaaccaaacatacttcttanttacccagtttctctctctctctctctctctcgaaattataaaaacaattaatgcatcctgacccttggaaatgcctcccagccctttaaacaaaatgcaggtttggngcctgc

SEQ ID NO: 39988 - DNA, 139 bp, Homo sapiens
  misc_feature 7, 35: n = A,T,C or G
ggcgcanctagatatagtaccgcaagggaaagatnaaaaattataaccaagcataatatagcaaggactaacccctataccttctgcataatgaattaactagaaataactttgcaaggagagccaaagctaagaccct

SEQ ID NO: 39989 - DNA, 107 bp, Homo sapiens
gtgaaacttaaataatagacatacaggagatatacaaatatattatatatttttctgagatttttgatatctcaatctgcagccattcttcaggtcgtagcatttgg

SEQ ID NO: 39990 - DNA, 152 bp, Homo sapiens
  misc_feature 8: n = A,T,C or G
aggaatanggaactcaggcaggtatttgagtaacaatgtgtgtgagcgttgtgtgcgtatacgcatgtgtgcatgtgcacaggagctaatgaaattaaaaatgagccaccgtgcccgaccaagcctgggtaagagaatgagaccctgtctcc

SEQ ID NO: 39991 - DNA, 450 bp, Homo sapiens
  misc_feature 7, 33, 34, 36, 214: n = A,T,C or G
aatgaancaaattttaccataggccaattgatnntncaagatataagttcctactgcatatttctggtcacaatattatcactgtacttctaaatggagactaaaacacttataacattcaacactgaaataagtgtgaggtatacatacatttttaaaaagattaataaaaacaagtaagatgattatttacccaattattccagttcagagnctcgggtggcaagaacctattcttactcagcatgcaatgcaggaataaaccctgcacaggatgctattccatggcagggcacaaccacattcactcacattgggacacacagtggggaaatgccaattaaccagacatgcacatcttggggatgtgagaggaagcaggacttcctggagaaaaccccatgcaggcatggggagaacatgcagacccctacacagatggtagccctg

SEQ ID NO: 39992 - DNA, 217 bp, Homo sapiens
  misc_feature 33: n = A,T,C or G
gaggcactgaggcagccagcgcaggggcttctnctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagt

SEQ ID NO: 39993 - DNA, 358 bp, Homo sapiens
  misc_feature 6: n = A,T,C or G
catttncgatggcttcctgccaaaacaagtcttcagaatgggaggaggtatcatgtgctatctgccagtgtaatttatctttccatgtagctattgaaaactattccaagtgtgcctgcattataacctaatctattgcttatctctaaaaaacaacctttgtgctcatcacaaataaaacatgaaaataatgatagggtcacttttgtggctttctgtgaagattaacttaaataatatatataaaaaatttgaaagagtgcatagccaattgaaagtatggaaagtggcccggcactcatgcctgagattccagcactttgggaggccaaggacaacaaacccagtcctcacctct

SEQ ID NO: 39994 - DNA, 417 bp, Homo sapiens
  misc_feature 270, 301, 382: n = A,T,C or G
ctctgcctgctaatctttgaaatctactgtgcttacatgcctctgccaccccatctatctctgggaaaagctcaatatcccgatagattatcctaaggtgggcttgcagggcagcactcagtcaacaactctccagcctgggtgacagagtgagaccctgtttctaaaaaaaaaattacatttctattattactaatgataatgcgtgtctcttcatatgctttttacccactttgctaccctttttaatgaaatgccgattactatggntggaatatttgtccccactaaaactcatggngcaaccttgatatggtttggctgtgtccccccaacccaaatctcatcttgaattgtaatccccataatccccacatgttgngggaaggacccagcaggaggtaactgagttatggg

SEQ ID NO: 39995 - DNA, 211 bp, Homo sapiens
ggggcacggaggtgcctgattgagtctgctctgacctctcactctccccttcttctccaggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttt

SEQ ID NO: 39996 - DNA, 441 bp, Homo sapiens
  misc_feature 8, 34: n = A,T,C or G
ggtaggancctctctccctactgctgctacacangtaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctg

SEQ ID NO: 39997 - DNA, 436 bp, Homo sapiens
  misc_feature 7, 33: n = A,T,C or G
gaggcantgaggcagccagcgcaggggcttctnctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttg

SEQ ID NO: 39998 - DNA, 385 bp, Homo sapiens
  misc_feature 213: n = A,T,C or G
gtgtgcgaaaagctttcgtaagataaattgctatgcacatataagttgttatctgattatcatttttctgaatgaaggaccagtaaagatatggtagaacagatgaaatctgaactgggtcccaaagaatgggtagtactttcacaggtgcagaatcttgaaatggaattttaggcagagggaataatagcatgaggaaaaaagaatcatggntataaagtttaggggactgtctgggagaaatcaacagtttatttaaccacgggccatatttatgtggcaaagtagtgcaggagaagcaaaacaaagcagattatgccatattttgaaggaacctgaagtcaaagccaaaaggagcaagaagtggaggaggaggaagaggaga

SEQ ID NO: 39999 - DNA, 475 bp, Homo sapiens
  misc_feature 34: n = A,T,C or G
caccacctttcctggccttgctatgggatgcttnccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgaga

SEQ ID NO: 40000 - DNA, 213 bp, Homo sapiens
gtaaaaacctggacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctattt

SEQ ID NO: 40001 - DNA, 378 bp, Homo sapiens
tatggccgggattctacaagttgtctcttcactctgttgttttctttgttgtgaagggcttttttagtttactataatctcatttgcctatttctgcttttgttgcatgtgcttatgaagccttaaccataaaatctttacctaaatcaatctcctgaagcatttcacctatgtctttaattttaattgatttttgtataggtaagaaataagagtctagtatcattcttctgcatatgaatgtccagttttcctagcactgtttatttaagagggtgtcctttccccaatgtatgttcttggtgcctctattgaaaatcagttgtatgtttctgggttctatgtatgtttttgggttctctagtatgtatgtttctg

SEQ ID NO: 40002 - DNA, 369 bp, Homo sapiens
  misc_feature 7, 32, 212: n = A,T,C or G
catttanttgctgttattgatagtggtgaacntttatgaaaaagaagtaaaaaaccccttgccggccagatgcggtggctcatgcctgtaatcccagcactttgggaggccgaggcaggcggatcacttgagattgggagtttgagaccagcctgacgaacatggacaaaccccgtctctactaaaaatacaaaaaattagctgggcgtggngttgcatgcctataatcccagctactcaggaggttgaggcaggagaatcgcgtgaacctgggaggtggaggttgtggtgagccgagatcacaccattgcactccagcctgggcaacaagagtgaaactcagtctccaagaaaaaagaaacaacaaca

SEQ ID NO: 40003 - DNA, 490 bp, Homo sapiens
  misc_feature 7, 31, 33: n = A,T,C or G
gtcaccntgcgtcagaagactgtggactggntnagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccccgggagcctcacgtattttagaagccaagagaagccacatggagactcaaattcgcatcttctctatccacatcatgaccaaaggaacccctccctggtgtctgatcagggctgtggcatcacgaaacattggatcatgaca

SEQ ID NO: 40004 - DNA, 368 bp, Homo sapiens
attctcttgactgtattttacctcatttcttgcaatcttggtttttgtttttaaatccttgtcatgccctggaaatgatctgtttcaggaagaatagatttctgttttataagtagaaaattctgagttttgaaaataattacttaattgctaataataaagaaatgtagcctggacaacacagcaagaccatgtctcttcaaaaaataaaaaataaattagcagggtgtggtcttgcacacctgtagtcctagctattcgggagggtgaggtgggaggataacttgagctgaggagtttgaggctgcagtgagctatgattacgccactgcactctggcctccagagtgagaccctgactcttaaaa

SEQ ID NO: 40005 - DNA, 472 bp, Homo sapiens
  misc_feature 30: n = A,T,C or G
aactccagaaatgatcgctcgttctgctgnttccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtacatgctacaaaaagaggggaatatgagccgagga

SEQ ID NO: 40006 - DNA, 102 bp, Homo sapiens
agggtgatcacagctcaccgccaccttgacctcccggactcaagtgatcctcccgtctcagcctccacagtagctaactggaactacaggcatgagccaccg

SEQ ID NO: 40007 - DNA, 375 bp, Homo sapiens
gtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtaga

SEQ ID NO: 40008 - DNA, 472 bp, Homo sapiens
  misc_feature 6, 34: n = A,T,C or G
aatctncaattggggcagtactcatggcttctcntttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcaggagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaac

SEQ ID NO: 40009 - DNA, 177 bp, Homo sapiens
  misc_feature 3, 86, 135, 154, 161, 176: n = A,T,C or G
atnactgcccaacatcagaaaacctgacggctatgattactatgccttttctaaagatcaatactataacattgatgtgcctagtngaacagcaagagcaattactactcgttctgggcagaccttatccaaagnctggtgcaactgtccttanactgatnagcaaaggaggaggna

SEQ ID NO: 40010 - DNA, 379 bp, Homo sapiens
  misc_feature 6, 32, 94: n = A,T,C or G
aagggnaaatctgcacagttgctcccaccaantctgaatggatttgaggttcagctgcaatgcagtggtgtgccattgggagaaagaatacttnagtgagaaattccgcaggttctcctcctggtaggtgtgtgtcctcagtgagccagagacaagagacccaaatttgccattcccagagttggccccagttcccttgtttctcttatggtgtgagcaccttgaggcaccaagcatgtgtctggtgtttgatgatatttatttctcatacgatatggccctcatagcaagccaattaatttattggccactcaaatactcaatagtctgactcagcaatggaaggcagatggttgtgttggactcattggaagataac

SEQ ID NO: 40011 - DNA, 485 bp, Homo sapiens
  misc_feature 7: n = A,T,C or G
atccccnagattcatcacaattcactccctgagaatagacagaaggagaagccctacaagatcacactggagttttccccaagttgagtaagtctctgatggtttcctccttgaaggcaggaactgggctgtgcaattttttgagactcttaccagctctcaatccatgcctccatatagtgaatccctcatgttttagctcattagcatctccaaactctttatagcattgcatttggatctctccagtgaaagtatttctttatatgaccaaagataaaggactttggcttcactttttggaatagttcattgatcattaggtaccaatttttagtgcttcattaaaagtgaaagtaatttattgtaatgggattatgtggttcccaacactgagagaacattgaacccagaatgtgacactaatcataaaaataaaatgctcactctcatcttcttgaccagtgggaaattgtctaatattt

SEQ ID NO: 40012 - DNA, 457 bp, Homo sapiens
agactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatac

SEQ ID NO: 40013 - DNA, 177 bp, Homo sapiens
catctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaagaataaatttttatat

SEQ ID NO: 40014 - DNA, 487 bp, Homo sapiens
  misc_feature 4, 27: n = A,T,C or G
accncaggtgactccatggcctaccantttggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagt

SEQ ID NO: 40015 - DNA, 412 bp, Homo sapiens
aggcacacgaataaagataggattgggaaagaagttgctaagtgtgcttagttttaataagtaattccttctctttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaagaaaac

SEQ ID NO: 40016 - DNA, 228 bp, Homo sapiens
atacttctgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtgg

SEQ ID NO: 40017 - DNA, 452 bp, Homo sapiens
caagaactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggaagtcggacgaggatat

SEQ ID NO: 40018 - DNA, 482 bp, Homo sapiens
  misc_feature 7: n = A,T,C or G
aactttnaactgatttaatatttctatttacatttatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatg

SEQ ID NO: 40019 - DNA, 289 bp, Homo sapiens
  misc_feature 17, 34, 286, 289: n = A,T,C or G
gatctccacctattctnaactttaaatgggtaanaagcccggctcgctggcgtggagccgggcgtggaatgcgagtgcctagtgggccacttttggtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatncan

SEQ ID NO: 40020 - DNA, 453 bp, Homo sapiens
  misc_feature 33, 34: n = A,T,C or G
gcagacgaggttagacaccttaagaccaagtcnntcggatgaggagatgctgttcatctatggccactacaaacaagcaactgtgggcgacataaatacaggacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttg

SEQ ID NO: 40021 - DNA, 343 bp, Homo sapiens
gctttccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 40022 - DNA, 471 bp, Homo sapiens
  misc_feature 377, 422, 430: n = A,T,C or G
agttggcttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtggtcccggcactgtgggaggctgaggcgggaggatcatctgaggccaagagttcgagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatcngatgatgaacttaatgtttccatttgtattaatggaatactaagnccctctgngatttctgaaccaagctattcctaggcctgagttttatttt

SEQ ID NO: 40023 - DNA, 250 bp, Homo sapiens
  misc_feature 33: n = A,T,C or G
gatctctactattgaggaaaaattggaggcatnaaactccaagggcaaaacatgaagactcgctggcccaccatggatggaggttttctctcttaaaattcccacagcaccgcatggaactgcctctcctgggacctcagcgtttccttctttgctctaagcaatagcctctgccactggagattctgagatggccgatttccttttggatatttaagttttgaaatcatgctcatttggcataggaatg

SEQ ID NO: 40024 - DNA, 302 bp, Homo sapiens
  misc_feature 8: n = A,T,C or G
caaagaanagagtaaagctatgtcttcaatttaatttcatacctgatttgtactttccttgaaagctttactttaaaataccttacttataggcctggtgtcatgctataagtatgtacatacagtttcacttcaaaaataaaaaaaaaatccctaaaaactctctatactctctataacaatactttattcaagaactctggacaatggtattatttttaaaaatcatggggatgtatttattagaatgtttcttataaatctgtttactttttatattaagaattaaactgtccctaaga

SEQ ID NO: 40025 - DNA, 471 bp, Homo sapiens
  misc_feature 5, 30, 31: n = A,T,C or G
aggancgaaaaacctacctgttttctatgnntcgtgacatatattctctggtagtccttgtgatcagacatacacataccacatattgattacaaatagggtattaaacaaagtaagtaactctagaccctaccaccacttcagtgacccgaaatccactatttaccaacaatagctagtaatagcaatttttggtcacataattaagcagcattttctttccctgattatttaagaaaaactaagtaaatttatctcactgaagaatattttaagccttaagtcaacattaaatttcttgttattgattataaaccagtatacttcaagaggatatatttctgtatataaaagtagtctttcataactgtctgtatttctaagttaatatataagtttatctagataaaaaatacttaagaaacataaaccaaaatattttatgaaattgtttttatattagctaagtat

SEQ ID NO: 40026 - DNA, 417 bp, Homo sapiens
  misc_feature 14, 32, 52, 58, 81, 99, 213, 363, 364: n = A,T,C or G
agatccttgcttanaactgattggaatctttntcgcctactgcctctctcgngccatnacaaataaccagtatgagatagngtaacccaatgtatctgngggcctattcctctctacctttaaggacatttagggtcccccctgtgaattaagaaagttgcttggctggagaactgacaacactacttactgatagaccaaaaaactacaccngtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgnngaaaccctgtatccctctgaaacactggaagagctagtaaattgtaaatgaag

SEQ ID NO: 40027 - DNA, 297 bp, Homo sapiens
  misc_feature 1, 5, 11, 17, 26, 34, 38, 109: n = A,T,C or G
nttgntcaagnggctgncaactcagnaccctggntggnatttacagacccttaatttaagtaaaacagaatgcctccatttagttctagaaggaccttctcctttagangaaccaagtgttcaaattcccttcttctctatgaactcagcattcattttatccataatgatcaatttaaaagtagagaaacttgtcagttgagagatctgattcccaagagattggtttcacttgtctacctgaattttgtgattggattttgttgttcgttttttaagattgaattttgttaccac

SEQ ID NO: 40028 - DNA, 423 bp, Homo sapiens
caaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataag

SEQ ID NO: 40029 - DNA, 463 bp, Homo sapiens
  misc_feature 33: n = A,T,C or G
gagctcccgggtggacctgcgggaccatggggntacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatc

SEQ ID NO: 40030 - DNA, 127 bp, Homo sapiens; identical to SEQ ID NO: 32606

SEQ ID NO: 40031 - DNA, 145 bp, Homo sapiens
aggcacgctggcacctgcctgtaatccaagctacttgggaagctgaggtaggagaattgcttgaaccgagcaggcagaggttgcagtgagcccagattgtgccattggacaccagcctgggcaaagaagcgagactccgactcac

SEQ ID NO: 40032 - DNA, 421 bp, Homo sapiens
  misc_feature 8, 34: n = A,T,C or G
ggctgttngtgatcttcatagtgggtgaggatcntctcagaggtaacattgaatcctttctttgtaaaggaaaaccttaattgaaagttactgtgccagcaatatataaagtgaagtctaggacccccagataaaattctcagaaagtatactcatgttctttctagagatagaaagctatataaattcagaggtaaaacttaattgaaacaagagctgactataaatatgttgttttatgaaaaattaagtagtgattcttacagccatggctttgtcctctctcattgagaattagtgtcataatgagcctcttttatttgtaggcacctatggtgtccctcaggtctgttaacaggagaaagggtaaataagtttatttagaaaacacctaaactaagtgtagttcatgttaattttc

SEQ ID NO: 40033 - DNA, 464 bp, Homo sapiens
  misc_feature 8, 20, 22: n = A,T,C or G
gagtgccngatgaccccagnancgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaagagaccagagagatatgcgggcaattcagcctgatgcaggttat

SEQ ID NO: 40034 - DNA, 215 bp, Homo sapiens
caaattcctaatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaaacatttataaagt

SEQ ID NO: 40035 - DNA, 395 bp, Homo sapiens
  misc_feature 1, 17, 34, 37, 54, 58, 63, 69, 70, 95, 101, 156, 169, 205,213, 288: n = A,T,C or G
naatctatattataaantagagataaatctattngangctctatgtaaggaganttanagccnaactgnntaagctgtatcatcccaacaaagtntccttncatgaacggggcatgcgatatgcttaagaattgctaggattaaattaaggaaagnaaagctactcagnagcagcaggttccacaagcacaaactttacacattngtacaatngggaaatgcactacaataaacaaattatgagcaacacatttgaaatacaggcttctttacataaactgagaggtnatacaaaactcagtttcacaagggaacaatctatacctttctaaaagttaatatttcaagtctctaataggcagaatattttactctttaaaatcctgcctttctga

SEQ ID NO: 40036 - DNA, 456 bp, Homo sapiens
ccgccggaaccgccatcttccagtaatttcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactttaagagccgagatagcttcctgaaacgtgtgaaggaaaatggatcagaaaaagaaagaagccaaagagaaaggtacctgggttcaactaaagcgccagcctgctccacccagagaagcacactt

SEQ ID NO: 40037 - DNA, 467 bp, Homo sapiens
gtataaccaggaaaatattgtatataatctcaagtcagattgttttcttttgaaaagtattcatatatgttaaagatgtagttctagttcattcattttctctgttttgactcttttatacatatactacagctcatttatccattttcctactgttgcaacatagattgcttataattcttctaattactaacaatgctggtatgaaattgttgtgtatatctctggtagatatgtgttatttcttttttgcaatgctagattataattatttgtctaaggtggagattaccagggtagactcgctctggccgtatgtaatgatgtctgtggctacataacctgccaacacttagtcttatcacacattttattttaaaatcaatatgtaaaaaatactaatttacttggtagtaatttaaatttttctgattattactgagggtgaatatgttttcatatgttta

SEQ ID NO: 40038 - DNA, 485 bp, Homo sapiens
  misc_feature 5, 32: n = A,T,C or G
aactncgcatccgcaaactctgtctcaacatntgtgttggggagagtggagacagactgacgcgagcagccaaggtgttggagcagctcacagggcagacccctgtgttttccaaagccagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctgggcttctatgtggtgctgggtaggccaggtttcagcatcgcagacaagaagcgcaggacaggctgcattggggccaaacacagaatcagcaaagaggaggccatgcgctggttccagcagaagtatgatgggatcatcctt

SEQ ID NO: 40039 - DNA, 210 bp, Homo sapiens
aaaagtcttaatgatgtaaaccctgactgctaacttaaaataaaaaatagtgattcaactatattgagaggatggggtgggggacatagtaagagctacacaatctcgtaactctatcataacaaaaaatttgtctaaatatgcctataaatgtctaaaatgacatatcaagaaaaaagaataagcataatactatagagataactaccg

SEQ ID NO: 40040 - DNA, 182 bp, Homo sapiens
  misc_feature 6, 33: n = A,T,C or G
gaaagnttaattgggagtggtaggatgaaactntttggagaagatagaagtttgaagtggaaaactggaagacagaagtacgggaaggcgaagaaaagaatagagaagatagggaaattagaagataaaaacatacttttagaagaaaaaagataaatttaaacctgaaacgtaggaagcga

SEQ ID NO: 40041 - DNA, 297 bp, Homo sapiens
  misc_feature 5, 31: n = A,T,C or G
gtggncattggcccagtctgtttcaaataantgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcatgagcattgtgcaatacagtttcattaactccttcccccgctcccccaaaaatttgaatttttttttcaacactcttacacctgttatggaaaatgtcaacctttgtaag

SEQ ID NO: 40042 - DNA, 414 bp, Homo sapiens
  misc_feature 27, 33, 35: n = A,T,C or G
gaaagaccagtggggtaaaaccccagnacgccntnaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatg

SEQ ID NO: 40043 - DNA, 462 bp, Homo sapiens
  misc_feature 31: n = A,T,C or G
taacataaattatacagccatagagtagttnttaaaggtttgctaaaaacgtgtaaaccatgcaactataacagtgaatttcagcctacattctcaattatgttggacccaatatttctaatagtgggaaagctattttcctaagaattaatccatatattgtctaaaggcaatattgccactttaggggcaacaattgcttcttgggagacaacaaaagcttactctttttatgtagacagcaaagacacatatacatatacagtatatctagtgcattaacatttcatatttggacaattaggaaaaactatttaaaatggttcactggggaagatgctagtgaaaaaactggagaaatactgatttaggctattatctacccttgatttattgatggttcaggagagaaagagggcagtaccgttctttttgcattgctttcttttcttgtttctcttc

SEQ ID NO: 40044 - DNA, 336 bp, Homo sapiens
  misc_feature 30: n = A,T,C or G
gattgcgaggagctgagggcagggtgaggnttgtttgactctggaagtatcaggcctgtgcagtaaactcagctctgctccgtatggagtcctgcggcctccacaaagagtcaccgctagctctcttgagctccagagcatattttgctaggccctgctccatacttcctaaaacaccactgcacagttgtcagtcataagagttcaactgccaaaaagattgaattatgctagaatgagaacacagcagtgttttgcatctcctcttatttctcgtgattgtgaaactaaagtgaaagagatcatttcaaccctaattctgcacatcagatattt

SEQ ID NO: 40045 - DNA, 316 bp, Homo sapiens
  misc_feature 34, 36: n = A,T,C or G
cacattgccccaagttatcatgtccatccgcacntngtctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagcacatccccaatcgtggccctctggacaagtggcgggccctgcactcatgagggcttccaatgtgctgcccccctcttaatactcaccaataaattctacttcctgt

SEQ ID NO: 40046 - DNA, 298 bp, Homo sapiens
  misc_feature 4: n = A,T,C or G
aagnatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaact

SEQ ID NO: 40047 - DNA, 251 bp, Homo sapiens
  misc_feature 34, 35: n = A,T,C or G
cttatcccagtaagatgggtgaccacctgacctnnctccacaggctgggtggcccggaggctgggctgggcgagtatctcttcgaaaggctcactctcgagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgat

SEQ ID NO: 40048 - DNA, 455 bp, Homo sapiens
  misc_feature 32: n = A,T,C or G
tgcttaccgttaagtttttaacgtaattttanttgcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggag

SEQ ID NO: 40049 - DNA, 230 bp, Homo sapiens
caggtgccccagatgtggtgtgagaggcaggctcacctctgtgggattctctcctaaaaccagtaacctttctttaatcatgagaaatacaccagatgacctgaggctggggatgttctacaggagacctgtccagcactccttaagctgagagggttattaatgcaaggtgggaccctggcttggatcctggggccgaaagaggatgtcagtggaaaaacagcaaaatc

SEQ ID NO: 40050 - DNA, 303 bp, Homo sapiens
  misc_feature 11, 35: n = A,T,C or G
gataacacagnagggaaagggaaagccacctggtncttgtccaccctgcctcccctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaccttg

SEQ ID NO: 40051 - DNA, 498 bp, Homo sapiens
  misc_feature 470: n = A,T,C or G
gagtcatgggggtggttaccctcatgctgttttcatgagagtgagttctcacaagatctgatggttttatatgggggcttttccccacttcactcttgttcttctctgtcctgccactatgtgaagaaggacctgtttgcttctgcttcagccatgattgtaagtttcctgaggcctcctcagccatgctaaactgtgagtcaatgaaacttcttttctttataaattacccggtctctggtatgtctttattagcagtgtgagaacagactaatacagtttgcaaagggggtcttgttatgtagatgaaacctcacaggtagcaaccctcagagacaatagatagtaaatgtttccttgagacctttaaaggtgtcagactctcagttagtctttcttggatccagacaagggagaaggcctggcagtataaatgcaggttccctacagatgatgtaaatttctcccangaaagacagctttgcagagctactttta

SEQ ID NO: 40052 - DNA, 487 bp, Homo sapiens
  misc_feature 7, 33: n = A,T,C or G
gaggcancgaggcagccagcgcaggggcttctnttgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgattaaaagaccttg

SEQ ID NO: 40053 - DNA, 346 bp, Homo sapiens
  misc_feature 30: n = A,T,C or G
agccccggggagagttctcttttctttgtnaagggcagggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattg

SEQ ID NO: 40054 - DNA, 444 bp, Homo sapiens
  misc_feature 31: n = A,T,C or G
tttgcactgcaatatattgagactaattttnaagctataataatgaacatacagtggcagtggcacaaataccaaatgccaaacgtgccaatggaataatagctcagaaacaggaccatgcatatttagatacttaatatatgatagagtggcagaacaaactccttaagcagtggtatagggacaattgggtatccatgtagaaaactcatgaaattggacttacctcagattttatacaaaattacctccaggatgcttatagacctaaatgtaaaaggcaaaattataaagctatttgcaggataatataggagaatatcttcataattttggaaaggatttcttatataaggcataaaaatcactatcatatggataactggaaaggaaaaaactgataaatttgactccgtttaagaactctgcatccaaagataagcg

SEQ ID NO: 40055 - DNA, 277 bp, Homo sapiens
  misc_feature 2, 4, 147, 155, 159, 217, 246, 259: n = A,T,C or G
gncncggagagaccccttcagagcagggattgtgccgggagagtgcctctgactttgggacatttcatccacagaaatttccaagccaatggtttcttttgggttttggtttttatgtttgttttttggggtttggaaaaacatgcntttttacngggngcgtgaattggtcagcagaaaagggagcccagaaaaggcagcagatggaccatacccncgctgggttttccttttctttgggactgngaggggaaatggnttttagaggtgagggttg

SEQ ID NO: 40056 - DNA, 494 bp, Homo sapiens
  misc_feature 23: n = A,T,C or G
cagtacgaatacagaccgtgaangcggggcctcacgatccttctgaccttttgggttttaagcaggaggtgtcagaaaagttaccacaggggggcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtg

SEQ ID NO: 40057 - DNA, 464 bp, Homo sapiens
gtgaaccctgtgatggagacaaagcagtggggtttggaaaccaaggaaggccccaccgacatcttacttctcggccatatgcctgcgagctcagcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatggggaagggctatgcctgcttccagtgccccaaaatttgcaaaacagctgc

SEQ ID NO: 40058 - DNA, 500 bp, Homo sapiens
taaaactacaggttctaccccagacagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagc

SEQ ID NO: 40059 - DNA, 187 bp, Homo sapiens
cttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtg

SEQ ID NO: 40060 - DNA, 184 bp, Homo sapiens
  misc_feature 7: n = A,T,C or G
atctganaacagaaataacaccttcaaaattgttgtgacaattaactgatgttaaaaatacaaatgggccaggcacagtggctcatgcctgtaaccccagcactttgggaggcagaggcgggtggatcacttgaggccaggagttcaagaccagcctggccaacacagtgaaacaccatatcta

SEQ ID NO: 40061 - DNA, 466 bp, Homo sapiens
  misc_feature 7, 60: n = A,T,C or G
caagtcncacatggtgagcgtggactttccggttatgatggcagagatcatctctgtgcnagtgcccaagaccctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatgggggttgtatgcctttaaatctgtgatgatcctcatatggcccagtgtcaagttgtgcttgtttacagcactactctgtgcca

SEQ ID NO: 40062 - DNA, 483 bp, Homo sapiens
  misc_feature 33: n = A,T,C or G
acccccaaacggattatccggaagccaaggttngctcggtatcttaaatagtgaagatggagaaatagtcaataatgaagagcatgaatatgcatccaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaaatgatgattattccccaccttctaagagacaaagaccaacgagccaccacagccaccaatcccagaacccgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctg

SEQ ID NO: 40063 - DNA, 296 bp, Homo sapiens
aaagaaagccccagcgctctagagctcagctgacgggaaagggggtgcgcagcctcgagtttgagagctacccggagctccaagacaggggtgggttccagctgcccgcacgccccgaccttccatcgtaggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaact

SEQ ID NO: 40064 - DNA, 221 bp, Homo sapiens
atgttatggctatgacagacatatctaggatttcttaataattcttaccctgtcaaatactgggtttgtttctagtattttcctgttacattgtaataaacatctttgtgaatatatacttagatgctcagtaaacctttatgcattatgaatgaattagagaagccttcttaggatttagggttattcctcaagaggatgattactaggtgaaagggtat

SEQ ID NO: 40065 - DNA, 171 bp, Homo sapiens
  misc_feature 34, 35, 59: n = A,T,C or G
gcacctccttctttgcatttaataataaatatannaatttctggctgggtgtggtagtncatacctgagtagctgggagattgagatgggaggatagtctgagcccaggagttcgaggttacagtgagctatgattgtaccattgcactccccctgaagaccccatctcta

SEQ ID NO: 40066 - DNA, 238 bp, Homo sapiens
  misc_feature 32, 33: n = A,T,C or G
gattacatgtgtctgtctggcctgatctgtgnntctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagact

SEQ ID NO: 40067 - DNA, 116 bp, Homo sapiens
  misc_feature 7, 9, 34, 35: n = A,T,C or G
aatgttncnccacccataatcctttctgccgacnnctagttccctctgctcagccaagcttgttatcagctttcagggccatggttcacattagaataaaaggtagtaattagaac

SEQ ID NO: 40068 - DNA, 487 bp, Homo sapiens
  misc_feature 29: n = A,T,C or G
ctctcttcctgtctttgtggctccggaanttcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcatt

SEQ ID NO: 40069 - DNA, 465 bp, Homo sapiens
  misc_feature 8, 31, 58: n = A,T,C or G
agtttacntttcttaggtttattcccacatntttggtgagatttgcccatgatttcanactttacctggggaaataaaccctattcctggttcacaatgtgatggattttgagaatttataaatcaggaaagacttataaatgcattccattttatttcatgggcatgtagcacaggataaagtggcaagaatcttcaactgctacatattttccatgattgtgagagctaaagcagaaggaaagtttaatgtttctcaaagagcaaagacaaacagaaagcagaaggcctgaggatcagcatcacataaacaacaagctgaggagcaggggatccccgagagagtcaagaaactgagggaggaaaggtttatgggaagggaagaagtgatgaatggtgtgaaatgtcacctagtggtcaagcaagaggatctgaaacattttcctttgtgtttatgaatttgag

SEQ ID NO: 40070 - DNA, 381 bp, Homo sapiens
ctgagcccggttctggggcgaaacgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttat

SEQ ID NO: 40071 - DNA, 127 bp, Homo sapiens
  misc_feature 25: n = A,T,C or G
aaagaaacccactaaattttgcttngtttccttgaagaatgtggcaacactgttttgtgattttatttgtgcaggtcatgcacacagttttgataaagggcagtaacaagtattggggcctattttt

SEQ ID NO: 40072 - DNA, 367 bp, Homo sapiens
  misc_feature 25: n = A,T,C or G
cattatcttaagtacattgtacatntctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaaga

SEQ ID NO: 40073 - DNA, 385 bp, Homo sapiens
  misc_feature 32: n = A,T,C or G
aagtgacagccttgtgtgtgatcttttctgtnttccccaagtttgcattttcgacattaaagtttactttttagttaaaagttttaaaaatatatatatataaatacactgtagataacatttgtatgccagctacacctttttctacttctgtttggctttttttccccacaccaatggtaatttatcttcacagattgttcttcatttctagaaattgttacttcatggtaattacttgagcaaaagcttgaaaatccctgacaagtacttttcatctcatagtatattagttttcactcagtcattttatgaataatatagttatccacttaaacatttcaatattttaaccatcttgaaaattaaagattaaaaatcccca

SEQ ID NO: 40074 - DNA, 443 bp, Homo sapiens
  misc_feature 32: n = A,T,C or G
cggtcccgtactgggagatacagccatccacnttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcat

SEQ ID NO: 40075 - DNA, 490 bp, Homo sapiens
  misc_feature 32, 34, 59, 212: n = A,T,C or G
gaaagaccctgactggtaagaccatcactctntntgtggagccgagtgacaccattganaatgtcaaggcaaagatccaagacaaggaaggcatccctcctgaccagcggaggttgatctttgctgggaaacagctggaagatggacgcaccctgtctgactacaacatccagaaagagtccaccctgcacctggtgctccgtctcagaggngggatgcagatcttcgtgaagaccctgactggtaagaccatcaccctcgaggtggagcccagtgacaccatcgagaatgtcaaggcaaagatccaagataaggagggcatccctcctgatcagcagaggttgatctttgctgggaaacagctggaagatggacgcaccctgtctgactacaacatccagaaagagtccacttctgcacttggtcctgcgcttgaggggggggtgtctaagtttccccttttaaggtttcaacaaatttcattgcactt

SEQ ID NO: 40076 - DNA, 457 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcacacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 40077 - DNA, 193 bp, Homo sapiens
gtgaggctgccttccggaaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagt

SEQ ID NO: 40078 - DNA, 364 bp, Homo sapiens
gaggatggataagtggataaaatgtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcagggattcagtttcacagttttaacttcaattttcttgtttaccccacaaatgacaaaattgcgtcattccttctctttgcccctttccaacaccaccccacaattttttaaac

SEQ ID NO: 40079 - DNA, 454 bp, Homo sapiens
tcaagacgattcttcccctcggcctcccaagtagttggtattataggcacagaccatcatgcccagcaaggtcactttcttgacacactgtctctcacatctttttctcttctttcatttttcaagacaatagctgtctgttcagagaaacagtatggtgggcagggcctcagtagggcaggggtgtgttcacagataagccacccattaactgcaacagaagctgggcctcagctgggcatggtggctcacgcctgtaatcctagcactttgggaggccaaggtgggcggatcacctgaggtcacctgaggtcaggagttcgagaccagcctggccaaggtggcaaaaccctgtcgctactaaaaatacaaaaattagctgggcatggtggcacacgcttgtaatcccagctactcaggaggctgaggcagggagaactgcttaaacctggga

SEQ ID NO: 40080 - DNA, 390 bp, Homo sapiens
caaggacggcaagctgataagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgac

SEQ ID NO: 40081 - DNA, 469 bp, Homo sapiens
gggaagtctgcgtggtttctcttcctgtttgcagctgtctttttgtgaatttgtaaataaatacagaaatttaagttaatattttgtatcaattttgccatgaaatcaaaatattaagtgaatattattccaacattggtaagttatatttttattattttgttaatgtttcattaatggatgtattaaaatgctttagtataaaatactttgctcttacttagaaaaaggactttgaggctgggcactgtggctcacgcctgtaatcctagcactttgggaggctgaggtgggcggatcacttgaggtcaggagtttgagaccagcctgaccactgaggtcaggagtttgggaccggcctggccaacatggtgaaaccctgtctctactaaaaatgcaaaaactagctgggtgtggtggcatgtgcctgtagttctagctacagggaaggctgaggcacaagaatcgc

SEQ ID NO: 40082 - DNA, 159 bp, Homo sapiens
cgactcttagcggtggatactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcg

SEQ ID NO: 40083 - DNA, 142 bp, Homo sapiens; identical to SEQ ID NO: 23637

SEQ ID NO: 40084 - DNA, 247 bp, Homo sapiens
  misc_feature 179, 200, 213, 226: n = A,T,C or G
gagtagcatcaaaggctgttctcaaaaatgaaagacgaatgagcagacacagtgtgtcacatcagcaacttttttcccagtttctttgtaaatggaagtttatgaaaaggagaactaactcaaatcacagaatcctgtgtttgaaataaatggtcttgcaacaaacatttgcgtctgcnaatgtctaaacctttcaaaanattaaaggaaatnaatgctggcgtgncgcattaattgggcaccaccg

SEQ ID NO: 40085 - DNA, 440 bp, Homo sapiens
atagtactgtactatacgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgctatctgtgtaaaatggacttctgaccgcaagtatattatgtgtggatctgatgaaatgaacattcgcctgtggaaagctaatgcttctgaaaaattgggtgtgcttacatcacgaga

SEQ ID NO: 40086 - DNA, 313 bp, Homo sapiens
gatataaaatttaagtatttttctcttaaatattccctatgaaaaaggcaacaggacaaacatgatgatcaagatcctggaaatttggctacagtgtgagaaggaagacagttgtttacagtagcaactgtaacgtctggagggagtttatacccaatctaaagagtccagaatgttgccatatggcaacgtggacccaacattgttacaacttctaccttcaagccagctggaagtctgtttttgcttttttggttttttaatgtgaaattttttgatttgtaaatttggtagccaattgaaataaagaagg

SEQ ID NO: 40087 - DNA, 469 bp, Homo sapiens
  misc_feature 54: n = A,T,C or G
gaggaggatgtgaaactcttaagtatatctggaaagcggtctgcccctggaggnggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagccaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaag

SEQ ID NO: 40088 - DNA, 400 bp, Homo sapiens
cattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataagga

SEQ ID NO: 40089 - DNA, 257 bp, Homo sapiens
  misc_feature 19: n = A,T,C or G
agggatattttccccaagnaaatacatatatttcttttcttttttttatcatccagatcaaaatgtcaataaataaatttcaggatttcagaaatgtcaccatttacattcaaagtgggggaatatattgaaaaagtagatgcttactagtaggttagattctatttagtgaaccaaccgccttgtatatttggttgtaatttctgtctaagccaaaaccaaattattataagtcaagtcctttcatagttgctgac

SEQ ID NO: 40090 - DNA, 355 bp, Homo sapiens
ctcattcccttgactcatgtcttgccggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttc

SEQ ID NO: 40091 - DNA, 248 bp, Homo sapiens
  misc_feature 218, 230: n = A,T,C or G
tgagcaagggatctagaagaatagaaatgtttggatttaagatttcgaagagaccagcctggccagtatggtgacaccccgtctctactaagaatgcaaaaattggcctggcgtggtggcgtgcgcctgtggtcccggcaactcgggaggctgaggcggaagaattgcttgggcccgggaggcggaggttgcagtgagctgagatcacacccactgcntcccagcctggngacagaccagactttgtt

SEQ ID NO: 40092 - DNA, 371 bp, Homo sapiens
gaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttga

SEQ ID NO: 40093 - DNA, 125 bp, Homo sapiens
caaaaggacacttctgattaagacggttgaaactagagatggacaggttatcaacgaaacttctcagcatcacgatgaccttgaataaaaattgcacacactcagtgcagcaatatattaccaac

SEQ ID NO: 40094 - DNA, 306 bp, Homo sapiens
gggcgtgagccactgtgccggtatagaatgcccttcatagcaacatttcccccaatccaggaaccaacccaggatcacttgttgcctgttgttttttagacagagtcttgttctgtcgcccaggctggagtgcagtggcatgatgtcggctcacctcaacctctgcctcccgagttcaagtgattttcatgcctcagctactcaggaggctgaggcaggggaatcacttgaacccgggaggcggaggttgcagtgagctgagatcgcgccactgcactccagcctggtgacagagtgagactgcat

SEQ ID NO: 40095 - DNA, 467 bp, Homo sapiens
ggagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaaagaagttgatgaaatgatcagggaagcagatattgat

SEQ ID NO: 40096 - DNA, 306 bp, Homo sapiens
ggagccgacatcgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtggagatgtgtgggcacatgttatggcagattgaaaaggatctcattccat

SEQ ID NO: 40097 - DNA, 500 bp, Homo sapiens
  misc_feature 6, 23, 32, 40, 43, 45, 56, 63, 67, 81, 82, 92, 96, 106, 107,121: n = A,T,C or G
tggatnggggcccccttctcttnggcaagaanggcggagnacnanttgactactcncatacgngccnttgtttggatcggnntctagtcttnccgnttcttgaatnnctctgtgtgaaggngatatataatgaaaaggaattattacaaggtaaattggaccttcttagtgataccaacatggtaagactttgctatggatgtatacaaaaacctttattctgatggtattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagt

SEQ ID NO: 40098 - DNA, 469 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaag

SEQ ID NO: 40099 - DNA, 464 bp, Homo sapiens
  misc_feature 427: n = A,T,C or G
gttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggnttttgtcacttcatctcttcactaatggagatagctt

SEQ ID NO: 40100 - DNA, 181 bp, Homo sapiens
  misc_feature 181: n = A,T,C or G
cagtgaaattgacctgcccgtgaagaggcgggcataacacagcaagaccagaagacctcccttcaggtgccgggcgcaggaactgtgtgtgtcctacacaatggtgctattctgtgtcaaacacctctgtattttttaaaacatcaattgatattaaaaatgaaaagattattggaaagtn

SEQ ID NO: 40101 - DNA, 354 bp, Homo sapiens
ggaaatcccagtttataataggtaaaaatggcaacaacctaaaaccttttcaatagggaaatggagaaagatgctatgactaattccataaagtgtaactatatgcagcatgttcaaagaatcaaatatatctttactgcttccttgaaaagccattaagtaagaaaattaagatatggaacaaatgtaaaagtatgaatccattacattaaaacattatatgaatatgaatgtacatatgtgtgtagccactggggtaagaatggaagggcagggggaaacatggagggagaatatttccccatctttatacacagttgtaatgtctgaatttcttcaaataaacatttattg

SEQ ID NO: 40102 - DNA, 466 bp, Homo sapiens
ggagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagagacttcaaatgaaggagaaaacaatgaagaatcgaatgaagatgaagactctgaggctgagaataccacactttctgctacaacactgggctatggagaggacgccacgcctggcacagggtatac

SEQ ID NO: 40103 - DNA, 471 bp, Homo sapiens
  misc_feature 10, 26, 67, 68, 69, 71, 73, 92, 130: n = A,T,C or G
gaggaaaaangaaactatttgcaaanaatgagatatgtaagaagtctgccaggctctgaactacaannngnanaaaactggcttgtgaagtnggttatatatagagagagtaatggaagtgatccggagnagctaggcagagaccacattatgaataatgaggggtctaccatcaagacttttctcaaagaggtgacagatagagtgccatttgacttcagagaaggaatgacctgagacctcatctgggctctcaagagctcttcttagaattcaagtctcccgtggaccagatgatttctcagtagaaagtgtagataccacacaatactccttgtatctttcgttcccaggatatgatggacgatatctgtcaggagcaatttctagagctgtcctacttgaatggagtacctgaaccctctcgtggacgtggggtgccagtgagaggccggggagctgcacctcctc

SEQ ID NO: 40104 - DNA, 466 bp, Homo sapiens
ggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtca

SEQ ID NO: 40105 - DNA, 238 bp, Homo sapiens
ggggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaataaaagggtagcattattat

SEQ ID NO: 40106 - DNA, 404 bp, Homo sapiens
caatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaat

SEQ ID NO: 40107 - DNA, 208 bp, Homo sapiens
aaggtggaatcaatctaagtgtccatcagtggatggatggataaggaggatgtggtatatatccatagtggagtgctcttcagccctaaaaggaatgaaatcctgtcatttgcatcaacgtgggttgaactggaggtcattgtgttaagtaaggcaagctaggcacagaaaggcaaatatcccatgttctcgctcttatgtgagagct

SEQ ID NO: 40108 - DNA, 144 bp, Homo sapiens
gtacaggagcacctcctgtaatcccagctactcaggaggctgaggcaggagaatcacttgaacccaggaggcagaggttgcagtgagccgagatcacaccattacactgcagcctaggcaacaagagcaaaaaaactccatttc

SEQ ID NO: 40109 - DNA, 142 bp, Homo sapiens
aggggtgttgcaggagaagggagagttcaaggcaaacgcaaggactggacttagctccctaggtgccacagtcagatgccggacacggatttatatataaatatatatatataaatatattatacccactcatcacggccat

SEQ ID NO: 40110 - DNA, 334 bp, Homo sapiens
  misc_feature 7, 334: n = A,T,C or G
atcaagnacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtatn

SEQ ID NO: 40111 - DNA, 465 bp, Homo sapiens
gaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggccttttttttaaaaaacaaaaaccacaaaaattcccaaaccatacttgctaaaaatt

SEQ ID NO: 40112 - DNA, 458 bp, Homo sapiens
gaggcattgaggcagccagcgcaggggcttctgttgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagcagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgactaaaataatttgaaggcgatcttttaaaaagaga

SEQ ID NO: 40113 - DNA, 310 bp, Homo sapiens
atttaaaagtattggaattgttctttgatcagaatggaatcaaattagacatcaacaaaaggaaatttggggaaactacaaataattgaaaattaaacaacatatttctaaatagcctctgagtcaacaagaaatgacaaggaaactagaaagtatttttaattgagaatgaaaatgcattgtatcaattcatgagatgcagctacttagtgcttagaagaatatttgtagctttaaaaatgtctaggataaaagatctacaatcaacaatctttttttacttaaaaatctagaaatgaaaaataaatcc

SEQ ID NO: 40114 - DNA, 288 bp, Homo sapiens
aaccttggaagcaggaaaccctcctgcagaccctgccttacagagaagagaatacttgaaatatgacactcggggaattggtaacaccaggaggctgtttctactgtttgctgcatgatttgcagcttcaattggactactttttctaacaggaagaaatgagccttgggaataccaggacgaatatatatagtctacagactctgaaacaaagctgttataaaattattggatacaacttaaagtaaggggatagtctgtttttattagaagatgatccttctgtgt

SEQ ID NO: 40115 - DNA, 419 bp, Homo sapiens
gggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgt

SEQ ID NO: 40116 - DNA, 464 bp, Homo sapiens
cactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaact

SEQ ID NO: 40117 - DNA, 459 bp, Homo sapiens
  misc_feature 17: n = A,T,C or G
ggttctgttacaaagtnaggggaagaggtattactgaatttgtgagaatattttaagttgggaattactctttttatacaaaagacgatgatgattaggttcagaagcttgcctattataacctgctttgactcatagttgaagttccatattattcaaaaaagtttatggaaaataatattactaccaaactcaataaatgaaacagaaacgtaggatctctaagtgagaaatatttatttctttcatgctcaaatgcagattaattaaaggtaataagtgacacatggatgttcatatacattcagaaagggaacttggtgctttaaaaaattttagagcatatagcacaagccttcaaatctgttttcattttaaaatgtacagccctctttttttgatacaggtgtatcattaggactgactggttttacatttgttagccatatttaggattat

SEQ ID NO: 40118 - DNA, 159 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 40119 - DNA, 471 bp, Homo sapiens
ggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatca

SEQ ID NO: 40120 - DNA, 231 bp, Homo sapiens
aacctaaaaataaaataatgagtagtggtgatatgtataatttcacttttcattacatcttgaaagaaaacatgggtttttcattgttaagccagtttttttatagccttaagatgtaattcacatatcatacaattcacacgtttaagtatacaagtcagtggtcttcagtatattcagatttgtgcagccatcactactatctaatgttagaacattgtcatcaacccc

SEQ ID NO: 40121 - DNA, 340 bp, Homo sapiens
gtgctcataattgtccttgcctttccgcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaatataaaaattagcctggcatggtagcatgcgcctatagtcccagctgctcaggaggctgaggcatgagaatcgcttgaacctaggaggtggaggttgcattcaactgagatcataccacttcattccagcctgggtggcagagcaagactctgtct

SEQ ID NO: 40122 - DNA, 469 bp, Homo sapiens
ggcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacaagccgcatgttgaagtgtgaggcgtgaaagggtatgtctgatatttgctttaaaatgctccagcaaagaaattaagggatggatgaagcaaaagagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagccactcctctgga

SEQ ID NO: 40123 - DNA, 408 bp, Homo sapiens
  misc_feature 13, 407: n = A,T,C or G
ggagcagataagnagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacanc

SEQ ID NO: 40124 - DNA, 384 bp, Homo sapiens
caaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattg

SEQ ID NO: 40125 - DNA, 130 bp, Homo sapiens
  misc_feature 36: n = A,T,C or G
gcacaatactgtggtgtgttgctgttctttcttttnaagcaccagtatgaatttgataaagtaaattgttgttctagcaggaagcagttaggggtcacaaaataaatagccatagaattcaaataaatcc

SEQ ID NO: 40126 - DNA, 467 bp, Homo sapiens
ggcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccgggaccagcccgaagga

SEQ ID NO: 40127 - DNA, 388 bp, Homo sapiens
  misc_feature 128, 176, 214, 266, 298, 332, 355: n = A,T,C or G
gaaaggagagaaggaaatgaaatggtagctagtagacggtgaatttaagcaagatttgttccctttcttccactatacgcctctaaggaaattaaaaaaaaaaaggcttgtttagtttggaatgtggngtaaagagagcaacaagagattgaagtcaaagaataggtaagtgagcnctgtaaggatctgcagagacagacagaaaaagtctgcntggagagtaaattgggaagccaattaaaaaattttggtagtccttgcgtganatgttggtagcttaaactaggatagtagttgnggaagggatgattattggttggatacagtctatnttttgaagatagagttgactgcncttaatgacgaataagaaatgaggggtaagaac

SEQ ID NO: 40128 - DNA, 163 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatc

SEQ ID NO: 40129 - DNA, 445 bp, Homo sapiens
ggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgagaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaac

SEQ ID NO: 40130 - DNA, 287 bp, Homo sapiens
ataaactagaataataatgcccttaatgtgagggtttgtaatggtgcttattaagaccaaagacttgttaaatgtatacaccaagtggtaatgaaatttctgtgactggcccacgcgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttt

SEQ ID NO: 40131 - DNA, 355 bp, Homo sapiens
ggtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttattttttttataaatcaagacttctgtgtgctcttaaatatattaaaaacaatttacatttca

SEQ ID NO: 40132 - DNA, 289 bp, Homo sapiens
aaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 40133 - DNA, 468 bp, Homo sapiens
  misc_feature 6, 9, 393, 427, 439, 459: n = A,T,C or G
gatgcnganatatggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagccttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagccctcctcattgtntaaatgaggcctaaatgtgtgaagtgcgattttntgcttttgtgtnccccaccacccccattaccncaggtgcct

SEQ ID NO: 40134 - DNA, 326 bp, Homo sapiens
atttgtgtgtttgctacacaccaagcaccaccacatgcttttgaagttactgatgtttgtattctttatgttagctagtggatagaatactgaatggaataatattttggtctttgtgattagctgtgtgatgagacttttcaccttctctgttctctggctttagagccatacatttttgataacacgtatcactcacaaattttaaatagagttacaagaattgttgagcgattcctgaatagataatgaaagtggaattttcatttaaataagtaatagtgtgtcattattaagaagcagttactaaagaattacagtagttg

SEQ ID NO: 40135 - DNA, 296 bp, Homo sapiens
gttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagct

SEQ ID NO: 40136 - DNA, 246 bp, Homo sapiens
  misc_feature 5: n = A,T,C or G
caagnaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 40137 - DNA, 432 bp, Homo sapiens
gtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 40138 - DNA, 466 bp, Homo sapiens
ggcaagtagcgtgcgtgcccttgtgagtttggagggtgccggtcagcggagccgtgcgatgtatttgaaaagcaatcagtccgaccttcccccatagattcatcctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgccctggatgtgtg

SEQ ID NO: 40139 - DNA, 476 bp, Homo sapiens
gtacacatgctcttacacaactctcgccccatttggtttatccctgtgtctccttaacaatccagatgttctccctcttcgttgctcagtcttactgaggaattgatgagccctccggaccccagggctccacttatatatcgctgccctagtcatcagagttggttttattcttgcttgaaatgaagcctgacttcagtgtctctgtctatttcagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaat

SEQ ID NO: 40140 - DNA, 439 bp, Homo sapiens
gaagaccaaccacattggcccacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagttatggcagagctttacaaataaaaaaaaaactg

SEQ ID NO: 40141 - DNA, 227 bp, Homo sapiens
gttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaactcagttccacaataaaatacaaaagtgac

SEQ ID NO: 40142 - DNA, 249 bp, Homo sapiens
gaaaccgtgctgaagatgaaggcatctctcagaggaagtttctggatggcaatgagctcaccctggctgactgcaacctgttgctaacgctccacatagtacaagtggtgtgtaagaagtaccagggggcccgggtgtcatggctcacgcctgtaatcccaacactttgggaggccgaggcaggcagatcacttgaggtcaagagttcaagaccagcctagcctacaaggtgaaactccatctctaccg

SEQ ID NO: 40143 - DNA, 214 bp, Homo sapiens
cgaagatgtaaaaaatatgtacaaaactcaaatagatgaacttttaagacaaagtctcagttaacttgtgaaaattgaattcccatcaaactgaatgtgctgtggctcatgcctgtaatcccagcactttgggaggccaaggcgggcatatcacctgatgtcaggagttcaagaccagcatggccagcagtttggtgaaaccccatctctactt

SEQ ID NO: 40144 - DNA, 480 bp, Homo sapiens
agctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaagtcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctcccttc

SEQ ID NO: 40145 - DNA, 109 bp, Homo sapiens
  misc_feature 72: n = A,T,C or G
aatctgtgaagtttctgtcattcgtccgatctgtgtgtgtagcatgtgctgaggaagcacgtgctgggctgngcctcagacagtgcatcaccgggcacccagaggcttg

SEQ ID NO: 40146 - DNA, 473 bp, Homo sapiens
gtgggaaatgaccttgcttttgagtgcaaaggccaattttatgattattttgagaccggatataatgaaagaaacaatgtaaatgaatcttggaaaaagtccttacggaaaaaggaggcttcaccaccaagtaacaaactgtgctgcagcaaaggaagtaaaatatgagccatcttctcaccgaactttgaagcatgcacagcatgatcagttagctctcgtaaattttattttgaatggattttgtagttttgtacaacagataaaattatgccatgaacatgccatgtcgttttaatgcctggagagcagattgcgtaaaacatctgtatagcaggcatcagcgagcttcttataaatgtggtgatttttaccaaggaaacgattgacttaatgcttaaaagtatatcatagttttcttacggaaaagatcagtagatgagattgggggacaatgtgcccttgcaatattt

SEQ ID NO: 40147 - DNA, 366 bp, Homo sapiens
  misc_feature 255: n = A,T,C or G
agagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccanatttaagaaagcgttcaagctcaacacccactacctaaaaaatcccaaacatataactgaactcctcacacccaattggaccaatctatcacccctatagaagaactaatg

SEQ ID NO: 40148 - DNA, 490 bp, Homo sapiens
  misc_feature 8, 9, 20, 34, 402, 406, 422: n = A,T,C or G
gtgggtannaaaacttcttnttcttaaatttacntactaagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcagtaaactgcatatcaacttcccacaaaagctgacttttttgggtctcttacatataaagtaggcattgagttgatttttttnggangtatctcatattgggncgaattcttctggtatggactcttgccttatatagaggcttctatttctcttaagtcagcatcaatac

SEQ ID NO: 40149 - DNA, 242 bp, Homo sapiens
  misc_feature 4, 9: n = A,T,C or G
tganacganacacactgctttttttgaaagctgattctcctgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaatactgtatgtatgtagagattgagttgtcaattaaaaaaaatgtggcctctt

SEQ ID NO: 40150 - DNA, 132 bp, Homo sapiens
  misc_feature 2, 35, 54, 62: n = A,T,C or G
tntattggccgggggaaaatggctgcctctaaaangggagccttttactagaanaaaggacnagagtaaacagctacatctcaaaacttgccagtttcactgttgaaactggtctggtgcagcaggaacaac

SEQ ID NO: 40151 - DNA, 494 bp, Homo sapiens
  misc_feature 8: n = A,T,C or G
gggccatngaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacgcagcagctgtatttgaagaaggtggtgatgtggacgatttattggacatgatataggtcgtggatgtatggggagtctaagagagctgccatcgctgtgatgctgggagttctaacaaaacaagttggatgcggccattcaaggggagccaaaatctcaagaaattcccagcaggttacctggaggcggatcatctaattctc

SEQ ID NO: 40152 - DNA, 260 bp, Homo sapiens
  misc_feature 4, 15, 30, 33, 54, 71: n = A,T,C or G
accnctttgttaaantctgcactttctaantantcaaaaagggaaatgaagtantaaatcaatttttgtanaatctgtttgaaacactgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctag

SEQ ID NO: 40153 - DNA, 182 bp, Homo sapiens
  misc_feature 18, 29, 30, 32, 37, 38, 62, 69, 84: n = A,T,C or G
cggcccggggggttgttnaaaaccctgcnncntgaanntaacaccactagtaacgtgggaantacctanaaaataacccaagantttctactttttgtaaattactactttctctactgtagattgtgtatgttatgtgtttttatggaaagctaataaattaaaggtacagtggtatcttg

SEQ ID NO: 40154 - DNA, 471 bp, Homo sapiens
cagtttccatctctgctacctagtgactttgtaaattacttggacaaggttgagcctctctgtaccttagtttcctcatgtacaaaagaaagttgataacaaaaagtatctgtctcaaagtatcagtctcaaaggatttttgttaatattaaactaattaatgcttgtaaagcccttaaaacagtctctggaacataataagtgcttatatgtttactgtcattatcattattttttccatccatgctattacttcacaaaatatatgatagtaatagggaacatatacttatccaaactaaaattgccccaatattcatgtgtttcttaaaatacctaaacatttatttctataaaaagaattggttaattcaaatcttgccgaatatcagaatttctccacaatttaagataaattgcaattggagatggggtactgatatatttaaaatatatgctttctaaaatttt

SEQ ID NO: 40155 - DNA, 481 bp, Homo sapiens
  misc_feature 12, 326: n = A,T,C or G
gtctcaaagaantctctgtaaacccggccctcctgttgtaccttaactttctgagtctttggaatgataatttcacctctcctaaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacggctgctgtgggctttttccagttcttcaccatccatttttataaaactcttattgttaaaaaaaaaagttactcanaatttcataaagccaaacacctgatttcaggaacacttgagatgtaagaaaattttatagggacctccaatcactaatcttcctattttttctctcaaagaaatgctgaagggaggaattcaggttgaatgaaaggaaatagtaacttacagcca

SEQ ID NO: 40156 - DNA, 147 bp, Homo sapiens
gtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtcta

SEQ ID NO: 40157 - DNA, 246 bp, Homo sapiens
ggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttac

SEQ ID NO: 40158 - DNA, 270 bp, Homo sapiens
  misc_feature 13: n = A,T,C or G
acaaagtcaagantaggcaagagttagagcaaaaacacagtgcatgaaaccccaggacactgtcagtcttgaattattgttcttgactatgtctgtctccaccactagactctctaatgctgaggactgtgatttatagagcctcacatggtgttttgcatgttgtatttactcaattaatgtttgctatatggatgaaacttgagaaacagaaacatcataattgttacttattccatagtcttgtctgtgctggcctcagtaataaag

SEQ ID NO: 40159 - DNA, 255 bp, Homo sapiens
atatcctgggacttcatgatgaattcctagatgggcaaaggtggattgaagacaaccttgatttcagtgtgaattcagaggtgtctgtgtttgaagtcaacattcgatttattggaggcctacttgcagcatattacctatcaggagaggagggaagaggaagaacgtctgagaaataaaattcgagctgatcatgagaaggccttggaagaagcaaaagaaaaattaagaaagtcaagagaggaaattcgagcc

SEQ ID NO: 40160 - DNA, 318 bp, Homo sapiens
tatggccgggacaaaaagtagaggcagctgcagccaccgcggggcctcagtgggggtctctggggaacacagccagacatcctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctggggtcggtggctgtctttccattaaagaaacaccgtcc

SEQ ID NO: 40161 - DNA, 229 bp, Homo sapiens
  misc_feature 5, 229: n = A,T,C or G
gaaantctggttgggcctggtgttagggttctttgtttttggggtttggcagagatgtgtttaagtgctgtggccagaagcggggggagggggggtttggtggaaattttttgttatgatgtctgtgtggaaagcggctgtgcagacattcaattgttattattatgtcctacaagcattaattaattaacacactttagtaagtatgttcgcctgtaatattgaaccn

SEQ ID NO: 40162 - DNA, 474 bp, Homo sapiens
cgggtgtgagtcttttagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatattatatgtcaatatttagtaaagcttttcttttttaatttccaggaaaaaataaaaagagtatgagtcttctgtaattcattgagcag

SEQ ID NO: 40163 - DNA, 473 bp, Homo sapiens
gaggaagcaaggaccccagactctttctagcaacccacggctctcaaggggactaatctcttcccaccagagtgagaactcactcaccactgtaggaaggcactgggcattaatctattcatgagggatctgcccccatgactcaaacacctgctactaggtcccatctctcaacactgccacattggggatcaaatttcaacatgagttttgtcagggacacaccccatccaaaccatagcaaacaggttgcaaatattggacaataggtagcacagaacattgatcctcaagagaagaacaaacagggtgagccctacaattgctccagcccaccatctacagagtatatctagactgcagtgaggggagggccaactcaaacagtcctctggtctccctgagttgagatgaagttgagaattagggggagaccaaagtggctagaattcccagggaagaataccagaaag

SEQ ID NO: 40164 - DNA, 470 bp, Homo sapiens
  misc_feature 11: n = A,T,C or G
gagataaaacntcgagctatggaataccctgggtgtgtgcaaatacactgtccaggatgagagccactcagagtgggtgtcttgtgtccgcctctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatatttgtagatgaactgaagcaagaagttatcagtaccagcagcaaggcag

SEQ ID NO: 40165 - DNA, 158 bp, Homo sapiens; identical to SEQ ID NO: 33266

SEQ ID NO: 40166 - DNA, 469 bp, Homo sapiens
atcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgta

SEQ ID NO: 40167 - DNA, 472 bp, Homo sapiens
tctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagaggggaaagaccattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcag

SEQ ID NO: 40168 - DNA, 208 bp, Homo sapiens
  misc_feature 174: n = A,T,C or G
caggcatgatggcatgtgcttgtagtcccagctacttgggagactgaggcaggagaatcgcttgagcccaggaggtagaggctgcagtgagccgagattgtgccactgcactccagtttggatgacagagaccttgtctcaaaacaaaaacaaaattagttaagatgatacatntttatgttatatggaacataacgttaaaaaattg

SEQ ID NO: 40169 - DNA, 472 bp, Homo sapiens
ggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattg

SEQ ID NO: 40170 - DNA, 470 bp, Homo sapiens
gtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgca

SEQ ID NO: 40171 - DNA, 473 bp, Homo sapiens
caatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaat

SEQ ID NO: 40172 - DNA, 178 bp, Homo sapiens
  misc_feature 9, 12, 31, 65, 78, 81, 82, 88, 90, 99, 135: n = A,T,C or G
acgaacctntanctattatggaccgggaaancaagctctagtgcagtcgcttgcataccaactgngatgagcctatgnatnntagagnancacgagagnccatttgtgctgaacaccatagatcaacactaattnacgtgtgacgacaacaagtaaactaggagaatgcccaggcctc

SEQ ID NO: 40173 - DNA, 471 bp, Homo sapiens
cttgcactctaaccaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatcttttgatgatacaatctctgcttttgccacaggtttgacattaacctagacgtttctgcccctgtgctcattaccctcccaaaacaatagttttttttaatgaattgaaacacaattagatccattcctgagttttcatttttaactatttactttggggtcaagttggtttctgcatcacaagggcattctcttacaaaac

SEQ ID NO: 40174 - DNA, 471 bp, Homo sapiens
  misc_feature 399: n = A,T,C or G
aaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggnatttgatgaagaatgaagtggcagcagaggaacccaatgctgcagttcctgatgagatccccccctctcgag

SEQ ID NO: 40175 - DNA, 473 bp, Homo sapiens
gtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatattttgcagttgtatattttacatttaaatattttaaaggtttgcatttgtatgcttaagacattgatttcctgttggtaagatgtatttttatcctcacaatttagatgtagctgctttaaatttatttgatgtatttcgacaggagtcgt

SEQ ID NO: 40176 - DNA, 190 bp, Homo sapiens
ggtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactt

SEQ ID NO: 40177 - DNA, 287 bp, Homo sapiens
caagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaacgcaagaaatgaagaaataaatccttggctcacta

SEQ ID NO: 40178 - DNA, 123 bp, Homo sapiens
  misc_feature 3, 13, 22: n = A,T,C or G
cantcggcctttnggccggggncgctgtctacactattaatattactctgacactacagtgacaatttcatatggttcaaccttatagtaatgatggctcctcattgactgttacttacagtt

SEQ ID NO: 40179 - DNA, 162 bp, Homo sapiens
  misc_feature 3, 15, 33: n = A,T,C or G
atnaatatggtgacnctcccgggagcgggggancaccaggttgcctaaggagggggttgaaatgtgggtgtttgaaacaaaagtgtataaacaaatgaattgttgataacttagttattgacctggagactggtagcttattaaagaaactccgtgttactc

SEQ ID NO: 40180 - DNA, 409 bp, Homo sapiens
  misc_feature 2, 16, 79: n = A,T,C or G
cnccctgacttaaaantctctgtaaaacgtgtagtgtttcctaaaatctgtaactcgcattttaatgatccgctatttntaagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatatttgggttgga

SEQ ID NO: 40181 - DNA, 208 bp, Homo sapiens
  misc_feature 9, 31, 71, 76, 79, 94, 131, 137, 138, 174, 175: n = A,T,C or G
ggttaaacngagggcccaggatttgggaaanatgacacctacactgtatatcaagcctattggctgctcanctganatnctgtcctttctacanagatctgtgtctgactgccttaggcacatacaggccntcctgnncttggattatcactgatgtctaattcctattacagnnattttaatactggctgtgtgagagactccttga

SEQ ID NO: 40182 - DNA, 460 bp, Homo sapiens
caggtaagttagtagattatcacatgttaaaaaacactcatccccgacctttgggagtgactaaagagttgtttatatgtactcggtaccctcagtaacacctcccaacccccaaatatcactttccttcccacacacataccacatacatgaactcttttgttgattttacatttgatttacattggtagggattttttcattctaacctgtactggggacccagtcacttcctctttctccagcattatcggtcacttatttactccctcgccattagagaattgttgtgagttttttgtttgtttgtttgtttgtttgttttttggagacagagtctcgctctcgtcacccaggctggagtgcaatggcatgatctcggctcactgcggcctccccctctcaggttcaggggattctcctgcctcaccctcccaagtagctgggctgcttcccccac

SEQ ID NO: 40183 - DNA, 472 bp, Homo sapiens
tagcaaataaatatgagcaagttaagtgaaattttacttcgtagcagtacctagatgtttatgtcatcataattttaagcccctttttatacataatttttaattaacttattttttattgaatttttaatcttaacaagtgaacagttgtaaatattgttaaaattggctgcaagaaataaacactttaaatataacatccagaaaacaatattatatttgtgtgtattagcttcttggactcaacttgtgctaattcagtatacaatatttaataaaatattcaacattttctatacatttattaaagtgttgttttaattatgattgtagaagactataaatctttataattatttgtttgtaatttacccaattatgtatcaggccagacctcaagaaaaggagaaatattaggctaaaatatcaatgttttatttgtccaggaacttcagtctgtatcagtttgtat

SEQ ID NO: 40184 - DNA, 441 bp, Homo sapiens
  misc_feature 22: n = A,T,C or G
cttgtaaaaacctgaacccagnaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattg

SEQ ID NO: 40185 - DNA, 473 bp, Homo sapiens
attataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatat

SEQ ID NO: 40186 - DNA, 484 bp, Homo sapiens
  misc_feature 1, 40: n = A,T,C or G
nctgtacagtaattccttgagctagatgattactatggtnagttcccatgatttgcaaattctgtatttgcaaatttacccattccctaaattttatttgtagaaacctttaatcacccaacaggaaatgacactgttatgaattttgtgcgccagtatagggccttgttttccaattatgatattaagattaataacttataatgtttaagtaactaaatgaaatggttgggctatatatctgactatatcctaacccctgataaaagtgaatttttagatcaccttttctttatcagtacctcttcacttctctattaactaggctaactgtattgggaggttgaccatatacagaattacattttaaaatctccctatgttacctgtttatgttattggacatacacagtttggaatgtagacactgttaatattttcaattataagacagaggcattttttaaattagttggtttcagac

SEQ ID NO: 40187 - DNA, 471 bp, Homo sapiens
attgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagat

SEQ ID NO: 40188 - DNA, 282 bp, Homo sapiens
atactttattacattaaatgcattggtctgtctgcattttgaatggatcttttaactatgtttgatactgtaatttcttgcattgatcatttgaagaatattggttttctgaaacacacagatcatctaaatgttgatacatttccttatgtaatactgaaaacaatcacattattgacatcatcatcaatgtatttaagtattgagaggttgtcaggctcactgtggtgaatactagttattcaaaatcttgttgctttaaagtccgaatgttgtaattga

SEQ ID NO: 40189 - DNA, 139 bp, Homo sapiens
  misc_feature 14, 102: n = A,T,C or G
atcgtataataatnggcactgttttgagatcatgtcaaagataacaaagcatcagaagcctcttctgttgctgaagaaccaatcaacctaaactaatacttnatgaccacttttcccaaagagaaaacaaattcaggcg

SEQ ID NO: 40190 - DNA, 257 bp, Homo sapiens
  misc_feature 257: n = A,T,C or G
agcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagtaagatccaaggagaaaacagtttacatttatctccttgatatctatttccctaagttgcn

SEQ ID NO: 40191 - DNA, 470 bp, Homo sapiens
gagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagc

SEQ ID NO: 40192 - DNA, 472 bp, Homo sapiens
  misc_feature 20: n = A,T,C or G
caacaagctcagcgttttcngggcttcccagaggtctgtgcgactagcccctgtctatcaaaagttactagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagt

SEQ ID NO: 40193 - DNA, 356 bp, Homo sapiens
attctcaactggcatagatttgactatgagcctcttacaggtggtttacagagtataatactctattattttgtatttttttcttgagacggagtctcgccctgtcacccaggctggagtgcaatggcatgatcttgactcactgcaactgccgcctcccagagtcaagcaattctcctccctcagcttcccgagtacctgggactacaggcacgtgccactacaccctgctaatttttgtatttttagtaggtcaggggttcgagaccagcctggccaacgtggtgaaaccccatctctactaaaaatacaaaaattagctgggggtgggggtgggtgcctgtaatcccagttac

SEQ ID NO: 40194 - DNA, 190 bp, Homo sapiens
ggggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacct

SEQ ID NO: 40195 - DNA, 147 bp, Homo sapiens
aatccaagtatgacatagccggtatgctttcatgaatgtttttatgtagattttcctcccatgaacatgagtaaataaatctgtttcctgagtggattgtggttgcatttaaagctctgtaataattctaataaatttactctatag

SEQ ID NO: 40196 - DNA, 470 bp, Homo sapiens
  misc_feature 26, 470: n = A,T,C or G
agggataaatatagatgtaatttttnaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgcaccttttgtagttttatttgtattactagattcataccttgatggtaacgctctatctggttttggggggtttttcatgttttagcatttgtataaagaaactggn

SEQ ID NO: 40197 - DNA, 399 bp, Homo sapiens
gtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggtttgatggaaaataaacatcagtttct

SEQ ID NO: 40198 - DNA, 444 bp, Homo sapiens
catgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattaagaagactatcaaaatacatgtatgtttcaggatatttga

SEQ ID NO: 40199 - DNA, 196 bp, Homo sapiens
gtagggataggtttagcatgaaagcagtttgggcgtaagtctgttcaaattaaaaaatgataaagctttaaaagtggttaagacagctgcacctgtaatcccagcactttgggaggccaaggtgggtggatcctgaggtcaggagttcaggaccagcttggccaaggcggtgaagccccatctctactaaaaatac

SEQ ID NO: 40200 - DNA, 473 bp, Homo sapiens
  misc_feature 16: n = A,T,C or G
cagaaaagagagagtnaaagtccgctaaagccgactcatccctgaaggtcaggaaaattgttcgcatgccaaagtgtgaccttctgaggaccatatcaaggttgtacacttcaggagaaagatacttcattgaagtagcccagccatgtcaacaaagaaataaacaccagcaataagtagccttgcagaattttatatccaaagttgacataatatactatctaaaatatccactttcaataaaatattatgaaacatgcacagaaatataaaaatcagacccataatcaaaattgaaataaggcaataatatctgcctttgagggtacacagatgttagtcttctcagacaaagcttcaaagaaaatgctataaataagtttaaaaaacaaagggaaataatgtactttaaaaaattgaagaacagtatggtaacaatgtccttgttgaataatatcaagaaaaagagacct

SEQ ID NO: 40201 - DNA, 372 bp, Homo sapiens
gaatcttcctagtttagatcttcattaattcttttaagtgatggttttcatttttttcactataaatttcctattgggtgattaatagtaaagtaagtaaagataaaagattatttttattggcatttatcttatgcctacataaaatttgctttatcatattatcacaggtctacaaagtttttttctagtcgtttctaacttaagttcactagctgcacatgggcatatgtgcctgtacccagctactcagaatgctgaggtggagggattgcttaagtccaggaggttgagcctgcagtaaaccatgattaggccactgcactgagctggggtgaaagaatgagaccttgtctaaaaaaacaaaacaga

SEQ ID NO: 40202 - DNA, 376 bp, Homo sapiens
gaaaccgtttagactctcaacaatgtatttttctttaaatttaagactttgactttaaaaggcacattttattttcatgtgcgacagctaacataaagatgtttgcatttctttgctgaaatcagtgtataggttgtttgtaactaataaactcttgtggcagatgattgttgggccacagtcatcagttttggggattgtgtgagaaacccatagcaaagtatggattaaggacttgggtttctcggcactgctacatcctccaaaaccaacatgcctttctgcaaagagaccagagctacattctgcaggtgtctgttttctttgaggggaacattttaaggaaacttaaaagggaggaactgagcatttagga

SEQ ID NO: 40203 - DNA, 464 bp, Homo sapiens
  misc_feature 457, 463: n = A,T,C or G
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctctcccatctgtctatctatctggctggcagggaaggaaagacttgatgttgggtgaaggaaagaagtgggggngggaana

SEQ ID NO: 40204 - DNA, 471 bp, Homo sapiens
  misc_feature 458: n = A,T,C or G
attgctcttggagccccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttgggggtaaagacacctggatcagactccaagggctgccctgagtctgggacttctgcctccatggctggtcatgagagcaaaccgtagtcccctggagacagcgactccagagaacctcttgggagacagnaagaggcatctgt

SEQ ID NO: 40205 - DNA, 464 bp, Homo sapiens
  misc_feature 42, 53: n = A,T,C or G
cggccggaaccgccatcttccgtaattcgccaaaatgacgancacaaaggganagaggagaggcacccgatattatgttctctaggccttttagaaaacatggagttgttcccttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtaccttgggttcaactaaagcgccagcctgctccacccagagaagcacactttgtgagaac

SEQ ID NO: 40206 - DNA, 450 bp, Homo sapiens
atcctctaaggagccacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggggaagggggcaaccccccagtagctttgcctgcttttataaagttgaacaaattgaatttagacattcaggctaacctgcctttcttagtactcctttgttggcatg

SEQ ID NO: 40207 - DNA, 301 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctat

SEQ ID NO: 40208 - DNA, 194 bp, Homo sapiens
  misc_feature 22, 34: n = A,T,C or G
cagacctggagtcccaaaagcnaaccgctctttnacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcc

SEQ ID NO: 40209 - DNA, 490 bp, Homo sapiens
  misc_feature 6: n = A,T,C or G
agtttnaactttcctagtagtcctactgcttcaggccaattttctccttgccctgcttagcctagtcacaatttccagttcttctctgtatcctgcagcagtgagttccaaacacttaatgctgtcatctcttcctgtgaaaaccaagaaataaaggttattataaggtataaataaagaacccagtgatttctcttggggtgtgtgtgtccatgtgtgtgtatattttacaagaggaaagttaaagatactaagaatgcctgtgaaagtaatcaggaaatggagaaaacttgttttccattctagcacctaatcctttggtgtggttttggcactagaaaacacaaaatatgtcctctgtgtctactaggaatgcctctcttcatttagtcctgcttgagtgctcatgatggaaaaatatagactgaaaacaggagcaaaaagtgttcatcctactcattccttgtggggtctctttgctttcaagaat

SEQ ID NO: 40210 - DNA, 320 bp, Homo sapiens
  misc_feature 15, 24: n = A,T,C or G
tatggccggggaacnacgcttttnatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacct

SEQ ID NO: 40211 - DNA, 155 bp, Homo sapiens
  misc_feature 2, 23: n = A,T,C or G
tntgctcttttttactcttgaantgtcacgtactgtctgattggcttgtagaattgttatagactgccgtgcattagcacagattttaattgtcatggttacaaactacagacctgctttttgaaatgaaatttaaacattaaaaatggaactgt

SEQ ID NO: 40212 - DNA, 436 bp, Homo sapiens
  misc_feature 7, 14, 30, 52: n = A,T,C or G
cgggaanctcggcnttatggccgagctaantaatcattgtgctgatattacntctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatggtaaaaagaatacaattcttttttacga

SEQ ID NO: 40213 - DNA, 492 bp, Homo sapiens
  misc_feature 10, 13, 23: n = A,T,C or G
gcgtgttgantcntgaaaagagnagtattaatctgaaagggatggtgatcctttgattttctaaatggttttaatgccattgcctttaattgtgtgagtgcgtgttgaatcattaaaagagaacattaatctggtcgtcccagccatattaatcagattaaagtcatcctactttgtgacctgataatgtttaaaaatggaaaattctcatggtggtgttcattcagtcatttattcaaaagataatcatcgtcctctgtataccaggcactgttctggacagtgggagatgtaatggtaaataaaataaacaccacctctgccctctcaaagtgtgtagcttagtgagaccacaagcaggtgtactgagactacacacctgggcgagagcacacagtaatgtgggcagctgaggaaaaggagggacacctaatccagccttggcaagctctcctaccttcgaagaatttatccagactccaacaacaaatc

SEQ ID NO: 40214 - DNA, 446 bp, Homo sapiens
  misc_feature 3, 11: n = A,T,C or G
agnactgaaantatttacttagtttcaaagtacctgtctactaaaataggtattaagtgttgtacaagggggaaaagaataacattacagtgaggaaacctggcagataccactttactcaggttggtcagatgattaaagtgaatgtcattggtaatgaggtaaattgaaatcacctgacaggatagtggaagacgaagacagcatcacttctgtgaaatccctgcccaaggtatgtaatcagaatcccatcatgaggcacacccaaatgagggacattctacaaaataactaccttgcaatcttcatagagtgaagattattgaaagtcaaggaataatgaggaactgttccagactgagggaaagaaaatatttgacaagcagatggtattcgtgcttctgaactgaattcttttgctctaataaaagacattttgggcacag

SEQ ID NO: 40215 - DNA, 227 bp, Homo sapiens
  misc_feature 6, 16, 32, 37, 52, 53, 59, 64, 75, 123: n = A,T,C or G
caaganacctgcggantgtctgctctatcccnttccnccctcagcggatgannaatctnaaganacctcccgagngtctgttcacttccccttccaccctcagctccaccctcagtggatgantaatctcaagaacacctcccgagtgtgtctgctcactccccttccaccctcagcggatgataatctcaagaaactaaggaagaataaataaataatataaaaat

SEQ ID NO: 40216 - DNA, 179 bp, Homo sapiens
  misc_feature 2, 3, 12, 26, 27: n = A,T,C or G
anncagtagagnctgctgtgaaagannctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtc

SEQ ID NO: 40217 - DNA, 298 bp, Homo sapiens
tatggccgggggaagtcttgctctgtcgcctaggctggagtgcaatggcacggtctcagctcactgcaacgtctgcctcctgggttcaagcggttctcctgcctcggcctctggagtggctgggattgcaggcacccgccaccatgcctggctaatttttgtattttttagtagagatggggtttcaccatgttggccgggctggtctcgaactgctgacctcgtgatccaccctcctcggcctcccgaggtgctgggattgagggatgagccactgcgcccggccgagtctttaaag

SEQ ID NO: 40218 - DNA, 205 bp, Homo sapiens
  misc_feature 24: n = A,T,C or G
tgtcagcagaggtcgcctccagangaggtgctgtggagactgagcgcatagcacccttaaaatcctgggaccagggcttctccacgggtaagcttaatgcaagtggagcagtgatttccagctagtgccaggcccaaggtggatgcactgtcaccttagttggattgctttttaattacctcatattctgttaaaaatcatattt

SEQ ID NO: 40219 - DNA, 202 bp, Homo sapiens
  misc_feature 13, 42, 44, 50, 92, 161, 165: n = A,T,C or G
ggtgaaacctccntctctactaaaaaaaaaaattagctgggngngggggngacacctataatcccagccattcaggaaggctgaggcagganaatcgcttgaacccgggaggcggaggttgcagtgagctgaaattgtgtcactgcactatagcttggganacanagcaaactccgtctcaaaaataaataaataaataaat

SEQ ID NO: 40220 - DNA, 482 bp, Homo sapiens
gaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagtggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctgggtggtgcctgctgtttgaaaccgccctgctatcttctggcttt

SEQ ID NO: 40221 - DNA, 437 bp, Homo sapiens
  misc_feature 13, 31, 45, 55: n = A,T,C or G
acagcagactcantgagtctgttaaaaaaantttttaacacttancttttttganttaaagtttattaattgaaacagatgcttttttgatagttcttaagtttcttgtggttttaaagtacaaaatgctcttcaaaatagcataagattaaaaagggcattgtacttggaaggatactgccctctagtctaatggaatcaaaggggaaaagaaatgaacacccacgcccccagaagagtagaaacccaagtggtctcttggcacttcctgtatcgctccattcctgtctttcaccctgctctctctgggtcaaataagtcaagtgtgtaacccccgtgcagttgtttttggaagaaacatgggagcagatataaaattaggatgtttcatcttgaggtgacagaagcaaaggacagttctgcgagaagggtatatg

SEQ ID NO: 40222 - DNA, 424 bp, Homo sapiens
  misc_feature 4, 414: n = A,T,C or G
gagngcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcggcagacatctggaggacctgttgatgctagttcagagtatcagcaagagctggagaggggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtnaaatttgtca

SEQ ID NO: 40223 - DNA, 419 bp, Homo sapiens
  misc_feature 2, 7, 328: n = A,T,C or G
tnggaangacgttggtgttgaggttagcactacgtattcaaggacagtaactaccctggctcccgaagttttgccaaaacctcggatgcgtggccttctggccaggcgtctgcgaaatcatatggctgtagcattcgtgctatccctgggggttgcagctttgtataagttttcgtgtggctgatcaaagaaagaaggcatacgcagatttctacagaaactacgatgtcatgaaagattttgagggagatgaaggaaggctggtatctttcagagtgtaaagtaatcttggaatataaaagaatttcttcaggttgaattacctaanaagtttgtcactgacttgtgttcctgaactatgacacatgaatatgtgggctaagaaatagttcctcttgataaataaacaattaacaaat

SEQ ID NO: 40224 - DNA, 479 bp, Homo sapiens
acacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcagggtggtgctgaaggagaaacacctcatatgcttctcaggccccatgtgttcatgcctg

SEQ ID NO: 40225 - DNA, 256 bp, Homo sapiens
ggagttttatatccaacatttcttactgatgataatgtaacttcttcccctttggtttaaaaatgactactttagagatacctcctagttattagaggtccctttctatatggttcaaaagagattacgtagagaagctaaccactcaaagctatcctttgtcagatatcctatatatgtgatatatttcattttatgaaaatgtctgaaagtatattaatagttattttcttttttttttcctttttaattatag

SEQ ID NO: 40226 - DNA, 121 bp, Homo sapiens
  misc_feature 1, 17, 29, 36, 37: n = A,T,C or G
ngccggggactctgagntgccacaggacntccagannggttcctctagcaggtctttgaatgtgttagtgcaggtttgaactcagagaagggtaagaggtaaaggtttaggagtcatttac

SEQ ID NO: 40227 - DNA, 281 bp, Homo sapiens
aggagatagggatattggcccctcactgcagctgccagcacttggtcagtcactctcagccatagcactttgttcactgtcctgtgtcagagcactgagctccacccttttctgagagttatttacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatgg

SEQ ID NO: 40228 - DNA, 172 bp, Homo sapiens
ctctactaaaaatacaaaaataagcttggtgtggtggtgcacgcctgtagtcccagctattcgggagactgaggcaggagaatcacttgaaccagggaggtggaggttgcagtgagccgggatcgtgccattgcactccagcctaggtgacagagcaagactctttctcagt

SEQ ID NO: 40229 - DNA, 473 bp, Homo sapiens
agctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggccccgagcaggaattcggtgtggacatagggccggtctgcttcttgtaaaaacctgaacccagaaacaacacaatccgttgcaaacccaaaggacccaagtactttccaatctcagtcactctaggactctgca

SEQ ID NO: 40230 - DNA, 217 bp, Homo sapiens
aggggaatggtggattaggttacttacagagtgaatgaaaacagaagagactctgggaggaaattctgggaagtcaccgtgatggttatgtagagtatgataaatatcagtataaaaagtgtcttaaactacccttgacttaacagtcattattcattcattcaacaaatatttaggcaccttctaaattccagacactgcattaggcactagagat

SEQ ID NO: 40231 - DNA, 101 bp, Homo sapiens
  misc_feature 2, 10, 29, 48, 54, 56: n = A,T,C or G
tngccgggancttgcatgtggatcaaccntcgctttattggctgaganatgaancntattgttgaaaggtaatttgagagaaatatgaagaactgaggagc

SEQ ID NO: 40232 - DNA, 385 bp, Homo sapiens
  misc_feature 384: n = A,T,C or G
tatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggaacaaaaatagattttctagaaactgcagactcctgtgattggagcagtatacaaagtacagcaacatcagactagatctcacctgaggtgctgggtgagaaatcttagggccagatgggaagagggccctgtgtataaagacattang

SEQ ID NO: 40233 - DNA, 471 bp, Homo sapiens
agatacgccattgcactccagcctgggcaacaagagcaaaattctgtctcaaaaaaataaataaataaataaaataaaataaaatttggctatagattgattctcaggagttcgcaaactttctgttaggggcagataataaatatttgagattttgcagcctgtactatctctgtggcattcaattctgactttttagtgcaaaagcagctatacacagtaagtcaatgaatgagagtggctgtgttccaattaattttatttgtaaacactgaaatttgaatttcatatatttttatgtcacaaaatattttcctttaaaaaattgttttcccaaccattaaaaatgtaacaatcattcttaggttgcaggccataaaaaattaggcaggctggatttgacccatgagccacagtttcctaactcctgttctgcatagttaccttcattataaatattttcaataattt

SEQ ID NO: 40234 - DNA, 274 bp, Homo sapiens
cgcagtggttacggctgtaatcccatcatgttgggaggccgaggtgggcagatcacctgaggccaggagctcgagaccagcctgcccaacatggcaaaaccccatctctactaaaaatacaaaaactagccgcctgtggtcatgcgcacctgcaatctcagctacttgggaggctgaggcacaagaatcacttgaacctgggaggcagaggttgcagtaagccaagattgtgccacggcactccagcccgggcaacagagtgagactacgtccc

SEQ ID NO: 40235 - DNA, 464 bp, Homo sapiens
  misc_feature 417, 420: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttaaaagttgnganggtgattaaaataattttggaaggcgatcttttaaaaagagatt

SEQ ID NO: 40236 - DNA, 477 bp, Homo sapiens
  misc_feature 372, 373, 460: n = A,T,C or G
gcttagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacgacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaanntgtggtcacaccaacaaccctgcgtcccaagaagagggcaataaaagggggggttctttcctttggaaagggcagcctcctgcccangccccgtggccctggag

SEQ ID NO: 40237 - DNA, 344 bp, Homo sapiens
  misc_feature 19: n = A,T,C or G
attgcaaacccagcaagantggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaat

SEQ ID NO: 40238 - DNA, 133 bp, Homo sapiens
aggaaggtattttctgacttgcaatgcagctagatgtaaaattttattttatcatactagaaagccttgactagaaaaatgaataaatattgagggtttcctgtccatatctggcttgcatgtgccagaaagc

SEQ ID NO: 40239 - DNA, 210 bp, Homo sapiens
  misc_feature 6: n = A,T,C or G
ctgacncacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttccac

SEQ ID NO: 40240 - DNA, 471 bp, Homo sapiens
acaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccggggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcgggtgtggacatagggccggtctgcttcttgtaaaaacctgaacccagaaacaacacaatccgttgcaaacccaaaggacccaagtactttccaatctcagtcactctaggactctgcactgaatggct

SEQ ID NO: 40241 - DNA, 471 bp, Homo sapiens
  misc_feature 427: n = A,T,C or G
gtgatttaaaaaattaaacatttgtttagctcatgaatccgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaaaggaggcaacctcataccagcccatgggtctaccgtttaattttcagaaatttggcaagctgattgttaacacagctgttgttnaattttatgtacttggaattaaaataatttacattaaaacaaag

SEQ ID NO: 40242 - DNA, 471 bp, Homo sapiens
  misc_feature 2: n = A,T,C or G
antaccgtatgttaatcctttggtgagggctagaattcttctgacatctttaattaaaattatattccatctatatggaacatctatatggtaacatacataaattttaatctgaaaggcatatattaaactaggatttgatttttttcctattgttattagccgtacttgctagtgggtggttgtcatcataacacattttctttgtcaaaggctcaaggtagcttgttggggccaggctgggctcaagtcaagtaaggtgttccatgtggcatccagatgttccctttcattactactggctgcctttggaaagctagctccaattttctggagctgttttctgaatattccccacacacatttcaaatagtgtagcttttaagctacttccatcttcgggtgttccagcagtgagaattttggatacacttacttcaagccgagtaagttaaagtacctccaattcag

SEQ ID NO: 40243 - DNA, 471 bp, Homo sapiens
ctccttgtggaaatttgagaccgcaagtactatgtgactatcattgatgccccaggacacagagactttatcaaaaacatgattacagggacatctcaggctgattgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatgggaaagtcacccgtaaggatggcaatgccagtggaaccacgctgcttgaggctct

SEQ ID NO: 40244 - DNA, 261 bp, Homo sapiens
  misc_feature 14, 235, 251, 256: n = A,T,C or G
gtgtgctcttggtntttccttcttgtgtgtgaaaatgtttgggaacagttctttgtgtagacaaagtggaaacaatttttttaaatggaagaggatgttttcactgtggaagagatggtagacagggcattcacaagtttgacctcccaaccaggctctgaaaaatctttatgaaccagctttccaccattcgtctttttttttttaatgggtccatagcttgaacccaggaggngggaggttgtagtganccacnattgt

SEQ ID NO: 40245 - DNA, 141 bp, Homo sapiens
  misc_feature 10, 18: n = A,T,C or G
atagctgatngttttttncctggaagcatttgtttctactttgatatgactgtttttcggacagtttatttgttgagagtgtgaccaaaagttacatgtttgcacctttctagttgaaaataaagtgtatattttttctat

SEQ ID NO: 40246 - DNA, 315 bp, Homo sapiens; identical to SEQ ID NO: 28837
  misc_feature 4: n = A,T,C or G

SEQ ID NO: 40247 - DNA, 183 bp, Homo sapiens
aaagactttgcagcctaatgcatgtgtcatgctaaaatagaagtagttagacatgtggagttaaatatggtgatggtttctcagatgattaaaatgactgccaccaggttaaggtagttacaaagcagctttctgtaatggcagcagagataataaactgggcaacaagggaggaaccaattt

SEQ ID NO: 40248 - DNA, 231 bp, Homo sapiens
  misc_feature 5, 22: n = A,T,C or G
aagantaaaaaggaaaatgatnatctccttctatagcatttgcagattcaagggggagaggtagatgctgagatcaaaatgacagttgttacttattttcccaggtgctgttagtataaacattgtttcctcttcacccctgctaactacctctttaaagtatttctaccaaactgtgaacccaatctcagggaaaagaaattaaaaagtaatataaattctgcatatatt

SEQ ID NO: 40249 - DNA, 362 bp, Homo sapiens
  misc_feature 23, 43, 358: n = A,T,C or G
agtcctcaggctgtaagcaagantacagcactggcccttggcngcgtcctaccctgcccaactccaaggactgggtatggattgctgggccctaggctcttgcttctggggctattggagggtcagtgtctgtgactgaataaagttccattttgtggtcctgcagcctctttctgtgacagagaatggctttgcgctgcccccaggaaaatggtaatgagagtaggtaggccggggctaccaacgggagatgcagtttatttacaccagcagccatgggggcagagggaatacacagcgtttacaaagttagctacctgtacagaatggattacatatgcaaaaataaaaatctcangaac

SEQ ID NO: 40250 - DNA, 441 bp, Homo sapiens
  misc_feature 324, 334: n = A,T,C or G
ggaggagactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtaagggttttggggtctggagctgtattagtatgtcaaactgccagtaagccagcccctcaccctctgatagatattcctttaatgcaccagacttcatgtttgataaatgattaatggntgaaaattgnttctcttcttttgtgttttcccagttaatagatggtcactgtttccacaatgttttatactttcagctttttgtaacttaactataattacttaattttattttttt

SEQ ID NO: 40251 - DNA, 397 bp, Homo sapiens
aacctttagatgccatgactctggaatgccagagtagtgcctccttacatcaaatctaatatatgaaatctctttaaatgctctttgaagataaagtatttgatgggttggattacaggcgtgagccccgtgcccagccaaaaagaaattttttaagaccagtaattctctactgtatggtttgtgggcctctgggagtctgcaaggtgaagactgattttgttgttgttgttgttttgagacggagtctcgctctgtcgcccaggctatagggcagtggtgcaatctcacctcactgcaagctccgcctcctgggttcatgccattcttctgccccagcctcccgagtggctgggactacaggcgcccgccaccaagcatggctaactttttgatt

SEQ ID NO: 40252 - DNA, 498 bp, Homo sapiens
  misc_feature 5, 9: n = A,T,C or G
ggatngggnaatatcctttgcctatctgttttaatatctattaacgacttgccccaattattacttgccccaattattactgtgacatttgccaaatgatgattttctatttttatcatttcttctacatatcttaatttatatttattaatttatttcagctgcaggaaagagctgtatcaactctctcatttatttgtttatttatttacttaaatcagtagacaatggattttttttcctatgggttacagttcattagtattaggatggcacaaaagcagtcatgattactttcaatggcaaaaccatgattacttttgcaccaacttaatattataaattttattgcttaatttgcttagttttattttctctgtctcaactctggaatcagccatttctccaaggagccctgattcatttcattgaaaatgatatttagaagccataatatggttgctaggtgtcctcatttctactgagagattattcctg

SEQ ID NO: 40253 - DNA, 470 bp, Homo sapiens
  misc_feature 409: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagttnaaagttgtaggtgattaaaataatttggaaggcgatcttttaaaaagagattaaaccgaag

SEQ ID NO: 40254 - DNA, 295 bp, Homo sapiens
gggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaagtgtttttaaaaaggtcatatattttttgctacttttgctgttttatttttttaaattatgttctaaacctattttcagtttaggtccctcaataaaaattgctgctgcttcatttaaaaaa

SEQ ID NO: 40255 - DNA, 471 bp, Homo sapiens
  misc_feature 212, 442, 469: n = A,T,C or G
gataataaaaataaaggaaatgtggccaagcgtggtggctcatgcctgtaatcccagcactttgagaggctgagggggaaggttcacttgagaccaggagttcaagatcagcctgggagacatggtgagaccccatctctacgaaaaaaaaaataaattacccaagcatgatgaggcatgcctgtagtcgcagctactcaggaggcttaggnggtaagatcacttgagcccagaaggttgagactacattgagccacgatcacaccactgcactccagttcagcctgagcaagagaacaagatcccatctcaaaaaaaataaagacaaaggaaatgctaaatttcagaggttagtaaaaataaaaacgcatttttttcaagttaaagtcacagacatcccctgaattctacctgtactcacctctatagaccccaggctaanaatctttggtcgacagaaaaatctgcnga

SEQ ID NO: 40256 - DNA, 303 bp, Homo sapiens
aacctaggctgggtgctatggctcacgcctgtaatcccagcactttgataggttgaggtgggaggattgcttgagtccaggagttcgagaccagcctgggcaacatagtgagacccccccgcatatctacaaaaaatgcaaaaattagctgggcatggtggtgcacacgtgtactacatttatagttccagctacttgggaggctgaggtgggaggattgcttgagcccaggaggtcctggcaacggtgagctgtgatcgtgccactgcattccagcctaggcaacagagaaagatcctgtct

SEQ ID NO: 40257 - DNA, 470 bp, Homo sapiens
  misc_feature 303, 356: n = A,T,C or G
gaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttngaatgtctcttcaatctccagaaagtctgaagatgatgagaaactgaaaaagnaggaaggagcgatttggggattgtcacaagttcagctggaactggaaccacagaggatacagaggcaaagaagaggaaaagagcagagcgctttgggattgcctgatgaaagag

SEQ ID NO: 40258 - DNA, 133 bp, Homo sapiens
aatctagtttacagaaaaatcttgtgctagaatactttttaaaaggtattttgaataccattaaaactgctttttttttccagcaagtatccaaccaacttggttctgcttcaataaatctttggaaaaacac

SEQ ID NO: 40259 - DNA, 164 bp, Homo sapiens
attgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaact

SEQ ID NO: 40260 - DNA, 497 bp, Homo sapiens
  misc_feature 2, 18, 40: n = A,T,C or G
cnccctgggaattcggcnttatggccggcagacccaaggnactatgaagttgatgctactctgaagtctctcaacaaccagattgagacccttcttactcccgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatatatgttagaaaggagtgacttccaaggaaatggctacccaacttgccttcatgcgcctgctggccaactatgcctctcagaacatcacctaccactgcaagaacagcattgcatacatggatgagggagact

SEQ ID NO: 40261 - DNA, 255 bp, Homo sapiens
actgccgaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttg

SEQ ID NO: 40262 - DNA, 158 bp, Homo sapiens
gactcttagcggtggatactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 40263 - DNA, 146 bp, Homo sapiens
gtgtttattgaatggtgattgcctgctttatttcagaggaccagtgctttgatttttattatgctatgttataactgaacccaaataaatacaagttcaaatttatgtagactgtataagattataataaaacatgtctgaagaca

SEQ ID NO: 40264 - DNA, 498 bp, Homo sapiens
  misc_feature 2, 13: n = A,T,C or G
cncctatagctgngatggatcgggggtccccatgttcttttagcttcagcctttaaaatactagtcattatttattatttcttcaaaagcccatctctaattgtctccttagggagtttttgagttcacattgacattaattgtcactaactgtcagcagttggcattaaccagactctattttaggattaaatccacctgatccacctgcactatcagaacattcaggacgcgactcaggctgcagctcagagggctccaccggtggccctagacttgcatcaagctgctgccattgccactgcaccagcttgtatgccaggttaccacatagtcctatgtaaccatgtgggccgctgtagagtaattcccctacttttgtcccccacttcctcaggtagaggctcgtagacattacattggatgagcaggcagctcagcttggtcagagccagccgtctgctccacccactttgtcctatcacagacccagtcgca

SEQ ID NO: 40265 - DNA, 165 bp, Homo sapiens
gctgaagttgctctgtacccatgaactcccagtttgcgaattatagagataatctattttgttacttgcacttgttattcgaaccactgagagcgagatgggaagcatagatatctatatttttatttctactatgagggccttgtaataaatttctaaagccgc

SEQ ID NO: 40266 - DNA, 274 bp, Homo sapiens
  misc_feature 5: n = A,T,C or G
cagtnagaaaggcaaaccgagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaccccat

SEQ ID NO: 40267 - DNA, 442 bp, Homo sapiens
  misc_feature 23: n = A,T,C or G
gtttgttttctttctaacagtcnggccgctctgctgcaggtcagctggagtttattgaaggtccactccagaccctgttttcctggctatcaccagcagaagctgcagaacagcaaagattgctgtcttctccttcctctggaagcttcttcccagaggggtagccacctgatgtcaaccagagctctcctatatggaggtgtccattgaacccagctggggaggtgtctctcagtcaggaagcacctgggttagggacccacttgagcaggcagtctgtcccttagtagagcacaagttctgtgctgggagatcttctgctctctttcaagccataggtaggcacatttaagtttgctgaagctgcacccatagccatcccttactccaggtgctgtgtcccaggggagatggggaaattttatctataagcccctaactg

SEQ ID NO: 40268 - DNA, 498 bp, Homo sapiens
  misc_feature 5, 18: n = A,T,C or G
aatgncaaacagaatgantagagtaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcgcactgagcatggtcagggcattggtcagagggacagagcaaggaatgcatcctgagcccacagctttgaccactgtgatccagaagagaggtgcactacgtgggaagtgctgattccacagcatgcagcctggtagggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtccca

SEQ ID NO: 40269 - DNA, 297 bp, Homo sapiens
  misc_feature 10: n = A,T,C or G
gtttagaatntacagcccttgatataaagttatttaaatctaaactgccacaataaatgttgaatgaatggttatttgtttatattataagttttattttctctgcttattggagaaccattcaccattgttctaattaattaataaatagacaaacttcttatatctctgccttctgaccatcaaactgaataattttaattcaacaggtcttattttcatttcctttgaaattttcctaattgccttcctttccaagtttaccataggtgccttgattcctttctggaataacag

SEQ ID NO: 40270 - DNA, 470 bp, Homo sapiens
gctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgc

SEQ ID NO: 40271 - DNA, 271 bp, Homo sapiens
  misc_feature 9, 22, 27, 28, 35, 37, 38, 49, 55, 63, 85: n = A,T,C or G
tgggtggangtgggtctggganggacnngggggancnntttttaagacnaaaganttctagangcctctgaaatgaaaaagaganttacttagcctccacactcgtctaaacctctctggggaaaacactaattagatggcatttgaaaattatgtacatcatactctactttattatgcagtatcaagaaaaaaacatgaatgcagttagcagccatggaaaccctggtaaaatttgacaatacttgtatttctacctcttgcaacctcc

SEQ ID NO: 40272 - DNA, 163 bp, Homo sapiens
  misc_feature 12, 15, 106, 162: n = A,T,C or G
aactgtaaagangancactggtttttttttcccctgcttccacccttctgatgattttgtattttatttttaatttacaaataataattgtatatttatggggtanagtgtgatgttttgatatatgtttacaatgtggactgattaaatcaggctacttanc

SEQ ID NO: 40273 - DNA, 471 bp, Homo sapiens
tgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccctctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggggtctggacaaagtgccaaaggatcttccccctgaca

SEQ ID NO: 40274 - DNA, 206 bp, Homo sapiens
  misc_feature 2, 3: n = A,T,C or G
tnnattggccgggggccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcg

SEQ ID NO: 40275 - DNA, 377 bp, Homo sapiens
  misc_feature 4: n = A,T,C or G
tatntaacaaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatattttttttgcattgactgctgagagctcctgtttactaagcaagcttttgtgtttattatcctcatttttactgaacattgttagtttttgaggtaatggaaacccactttttcattgtaatgactttgggggcttttgttagtaag

SEQ ID NO: 40276 - DNA, 472 bp, Homo sapiens
agccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgtctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttg

SEQ ID NO: 40277 - DNA, 330 bp, Homo sapiens
  misc_feature 3, 12, 90, 134, 135, 212, 310: n = A,T,C or G
tcnaactgacgntaaagtgagtctacctgtggagaggaccttccaaactgtggttaccctcagcttctctcactgcccaacactcagaanaacctgacggctactgacttacctactgccctttttctaaaganncaactacctactaacacttgactgtgccctagtagaaccagcaagagcaattactacttcgttctgggcagaccttntccaaagtctggtacaactgtccttagactgatgagcaaaggaggagtcaactaatgaaagaaatgaataataaattttgacactgaaaaacattttnttaataaagaatattgacat

SEQ ID NO: 40278 - DNA, 129 bp, Homo sapiens
  misc_feature 32, 45, 47, 64, 66, 87, 107, 117: n = A,T,C or G
ggcaggctcctgtaatcccagctactcaaaangctgaagcagganantcacgggaacccgggangngggaggttgcagtgagccaanattgcactactgcattctancctgggcganaagtctgtccct

SEQ ID NO: 40279 - DNA, 242 bp, Homo sapiens
  misc_feature 4, 26, 34: n = A,T,C or G
gaancgcaaacttcgtacttttctantgaagacngcgtatggccacagaagttgctgctgacgcctctgggtgaaagaatggaaggtaaaagttgacaaattgttgcagggttatgtggtccgaatcagtggtgggaacgacaaacaaggtttccccatgaagcagggtgtcttgacccatggccgtgtccgcctgctactgagtaaggggcattcctgttacagaccaaggagaactggag

SEQ ID NO: 40280 - DNA, 497 bp, Homo sapiens
  misc_feature 13, 15, 41, 42, 43, 44, 45, 65, 487: n = A,T,C or G
aacctcggccccncngggcccggggtcactcaactcctacnnnnnctagtctactgtgactaganaaaaccctacctaccttttttcctactgtttgtttagcgactttagcaaaatgttttcctactaactctcctctgtttacctagaagacaggttaaggaaatactacttacttattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagttagtagttaaatctgaatgtgtatggacaaaaatatttaattgctcagtaaactgcttaacttcaaagatagttattgaccttataaataaatatttcaaaattttgattccggaagactaagtctggacgtagacattataatgctacaaaagnaagtttgatc

SEQ ID NO: 40281 - DNA, 431 bp, Homo sapiens
  misc_feature 14, 24, 394, 400, 407: n = A,T,C or G
aacgcctgtcttcnaaccaaagangcaaggtgaaagcagcagttgctgatacagaagctgcagcaggttatccagaagatctagctaagatcactgataaaggtgtctacactcaacaacagattttcaatggagatgaaatagccttttgttggcaaaagataccatgtaggattttcctagctagagagaagtcggtgcccggctgcaacgcttcaaaggccaggctgactgtcttgttaggggcgaatgcagctggtgactaagttgaagccagtgctcatttaccattctgaaaatcctaaagccttaagaattctgctaaatctgctctgtgctctagaaatggaacaacaaagtctggatgacagcttatctgttaacagcatggttnctgagnttttttnaagtccactgttgaggcctactgc

SEQ ID NO: 40282 - DNA, 209 bp, Homo sapiens
  misc_feature 15, 75: n = A,T,C or G
agagcaccaacttcntcaccttcaggcttcagtgtactgggtaacactgaccctgtcgttctgcttgagacaganattagattttttttggaatttggatctttcatctgagttctttttcatgggcgggtcggggtcagtatcctgtttgttattgttaaatttgtatgaaccttagaaaagttattaaagtgccaaagaatgttcga

SEQ ID NO: 40283 - DNA, 500 bp, Homo sapiens
  misc_feature 3, 10: n = A,T,C or G
agnttcggcnacgtcaaatccttttctaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatgggggagatggtacccagaacgagtcacacagcagcttttcttagtgacactaaagatcgaggccctccagtgcagtcacagatctggagaagtggtgaaaaaggtccccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaac

SEQ ID NO: 40284 - DNA, 277 bp, Homo sapiens
  misc_feature 2, 4: n = A,T,C or G
tntntggcccggggggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgc

SEQ ID NO: 40285 - DNA, 500 bp, Homo sapiens
  misc_feature 15, 22, 55, 77: n = A,T,C or G
aaccctgtgaagacncacagantggccagggcagagtatcaacgaattttcagangcctcagttcttctccagatgntgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaaagctggttatgtctagactgcaattagccattgaggagagaggatgaagcaattgcacgagccaagcatatgggaaatgtctctaaaagtgctagaaaatatta

SEQ ID NO: 40286 - DNA, 130 bp, Homo sapiens
  misc_feature 4, 39: n = A,T,C or G
gatnctgttaccctatcaagctgaaaatgtcaccactantctggagatttcgacgtgttttcctctctgaatctgttatgaacacgttggttggctggattcagtaataaatatgtaaggcctttctttt

SEQ ID NO: 40287 - DNA, 442 bp, Homo sapiens
  misc_feature 3, 8, 49, 71, 98, 118, 126, 133, 161: n = A,T,C or G
acngacgngaactttgtcaccagttaacctgccttgtgagtgtgagaanatgttaaataagttcttcaganagagggaaaaataatacaggtcagaanacttggatctacataaaganaggaaganccttaanaaaagaataaatgaaggtaaaataagantttatttttgtattcttagtttagctaataaataaatagcaacattgcaattgaagattatatattatgggccaagcacagttgctcatgcctataatcccagcactttggtaggctgaggcgggtggatcacaaggtcaggagtttaagaccagactgaccaacatggtgaaaccctgtctctaccaaaaaaaattacaaaaattagccagtcatggtggcatgtgcctgtaatcccagctactcaggaggctggggccaggagtatcacttgactggga

SEQ ID NO: 40288 - DNA, 119 bp, Homo sapiens
agagaagatagggaaattagaagataaaaacatacttttagaagaaaaaagataaatttaaacctgaaaagtaggaagcagaagaaaaaagacaagctaggaaacaaaaagctaaggac

SEQ ID NO: 40289 - DNA, 227 bp, Homo sapiens
  misc_feature 104: n = A,T,C or G
ctaaggttttgttgtgttctgttgaaggtgccattttaaattttatttttattactttttttgtagatgaacttgagctctgtaacttacacctggaatgttangatcgtgcggccgcggccggccgagctgcctggcggggttggcccttgtcttttcaagtaattttcatattaaacaaaaacaaagaaaaaaaatcttataaaaaggaaaaaaaccaaccggtc

SEQ ID NO: 40290 - DNA, 245 bp, Homo sapiens
atccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttg

SEQ ID NO: 40291 - DNA, 115 bp, Homo sapiens
  misc_feature 8, 9: n = A,T,C or G
cactgtannccctttaaaaaagggtatgttgatttggtgccaacttcctttaaagccattgttcggaaaaaattagtagctaagctgatttcattctctttttgattactgttac

SEQ ID NO: 40292 - DNA, 215 bp, Homo sapiens
  misc_feature 21: n = A,T,C or G
attgaaccgatgaaatatttnactttcttgtaacaggagaaaagttatgactgatttaggtatcttccgtgcagttttggaagtatcttcttgaatacacatatgtgagcacatgggcagtaggccaaatgacatgtagtttttttccttctacagttttgaaaacctcataaatcaagagaaattgtccctcttaaaaaaaaagcaaacaacta

SEQ ID NO: 40293 - DNA, 490 bp, Homo sapiens
  misc_feature 3, 6: n = A,T,C or G
aanagnacgggtctaatagatcgctggagacacaatttaactgaaccccgcccgttgtggactgactttgatgctctgagtccctccctccttcacgccgctagcaggccctgatgtagattgtctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagcgcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggttttctgacctgtggataactacataaagagat

SEQ ID NO: 40294 - DNA, 277 bp, Homo sapiens
  misc_feature 5: n = A,T,C or G
cattnagctgcagctggttcccaggaaaatgaaagcagttccttctggttttttcctttcatatgaaagtcatagttcccagcagatggctttcatcagccctgtacatgtatctgtaaattcaaggccaaggaattattttcaacttcattagggaacaggtgaagaaaccatttgtagtgtggcactattttattaggagttgaaattaagcatagagattatagtagtatgccattctgggtcaaaatagtttttaactgtcagcaatttaaag

SEQ ID NO: 40295 - DNA, 274 bp, Homo sapiens
gagttcctgagtttgaagaaccgttggaaccttggcagtctggtttctagccttctgctatactgggtataaattttgtggcagtaaaactgaatatttccccttatatgaaaggagattgtgacctgtggtaaacaatgtgtatgaatttagggataccatttatttgatctcaaattcctggcctcaagcattctgcccacctcggcctcccgaagtgctgggattactgccatgagccactgcgcccagctcaagggatgccatttatttg

SEQ ID NO: 40296 - DNA, 440 bp, Homo sapiens
  misc_feature 2, 3, 361, 369, 371: n = A,T,C or G
anntggaaagccctcggatttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacatcatatgcatggacacagtgaccatgggcatggtcacagccacggatctgcgggtggaggcattgaatgctacatgagngggggggnantttctacattggttttggcagatacacttggcagcattggtgtgatcgtatccacagttcttatagagc

SEQ ID NO: 40297 - DNA, 183 bp, Homo sapiens
tggcccgggaatgtatatgttaattctaaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaat

SEQ ID NO: 40298 - DNA, 166 bp, Homo sapiens
agagctgtcctctagaaacactggacaccttcacccaacacccagtatcccctctgttgagatggactcaagaaccacagccattggaagagaagtggcagcatcgggttgttgaacagataccctaagaagtccaattccagccaccaggggctccactcgagga

SEQ ID NO: 40299 - DNA, 469 bp, Homo sapiens
gcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatat

SEQ ID NO: 40300 - DNA, 473 bp, Homo sapiens
atgcaggattcaaggaagaaattagaccagatgagaagtcaagctcgaagtagaaaatgtcatgatgagaaaaattattaaaaaacaggatgaacaaattgagcggtttgagaaaatcctgcagcattcaagtttgatgctgcaggtgtttgagagctagatgaagatatggacatttctggaattacagagccccctctacattgagcacaagacagtgacgaatccacattcttcagccagaaagtcacctctgagagccaaatgtctgataatagacaagagagtcagagaatgataacgacatctcaggaaaattgtgaaaataatcagcaaccttagggaagaaatataaacactggagattgccccagagctgcagtgggcagcctaggagtgccaagccatgatctacagccagcactcaaggaggagagaagcacattttcagatcattgagagtgaacatggct

SEQ ID NO: 40301 - DNA, 482 bp, Homo sapiens
caatatgtctcttttggacttcggggactaatatcaaaaaattaatgaggaccaaagttagaatttgattgtcgaaggtttgtcaaacataaaaagtttaaaacacttaatatcacaaagtaggatcacaggtcattgtaaagtcattcatttagacaaagcgataactcaaagattttttttaaggggaaaacctttattctttgagaggagacttcatttcccaaacaataagccttaataaagacaggatgaggccaattaaacttgttctccaaaattttataaacagcctataatattaaatagtttaatcatcttgaccataagatgtaatttccttaagccttttttataaccttttattaaggagtgggttaacgctccaagaaaaccttgttaatctgactcagaggcccatatgctagtcttgcatcactgccttcgacattaatggttaatttatagagaaactaaactta

SEQ ID NO: 40302 - DNA, 473 bp, Homo sapiens
  misc_feature 472: n = A,T,C or G
tgttgcagacatgggaattatatagatttgcacaggatcagcagttcctgacttcttttaacacttcagaatcaccattcccatgctttttcatcatccccagaccacctcaacccatgttttaaaatattacacttgtcaacaacctttatcaagtcataattaactaagttccctattttacaaccattagagtagttacatcattaaattgctagctaaatattgtgatcagcatgagttacccagtgagagcatcctacagagttatcatttcagctaccttcatccttttgcctgagcagcctaattgggtgcaggcatgatttccctttggctatttatttcaagggacttggacatcttcagcagagaaacatttacatgactcgagtattatttggaatacaactttgaacagaacaaacttatcaagtcattgattttggtataaaagcaaatggcaataagna

SEQ ID NO: 40303 - DNA, 278 bp, Homo sapiens
gttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattt

SEQ ID NO: 40304 - DNA, 208 bp, Homo sapiens
aattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctggtgactccaggcctgaatgacctagtgtggagagtttaaactatgtgc

SEQ ID NO: 40305 - DNA, 472 bp, Homo sapiens
  misc_feature 4: n = A,T,C or G
atcncaaataaacacattgaagagggtaggaagaactagttttactttatctgtattacccctccctcaaagcagcactgctcagagccaagagagactctctcacctgtaattccttctaagggggaaagcaagagcatagtaagtaagcacccagctcccccagccatccacaacactgcccaagagccccacttctttctcacctcacccagattgctgagataatcagcatggctgagagattgggagaggctgagagcaggaaagagaagctgctggccctctgaagtgttctacagactccatcaggaagcccatccacgagctgcttgagacacctcatctactgttcccaaactctacaccccccacccccagactgagtccctaaatgtgcccccatggacagtgaatgcaagcgtattatgtagacagccagctcaactctgtgggattggggaaaaaaggt

SEQ ID NO: 40306 - DNA, 296 bp, Homo sapiens
  misc_feature 14: n = A,T,C or G
cagggaattcggcnttatggccggacacagaggttcatgcctgtaatcttagcactttgggaggctgaggcatgtggattacctgaggtcaggagttcaagaccagcctggccatcatgatgaaaccctgtctctactaaaacataaaaatttgccaggcatgatggcaggtgcctataatcccagctactcaggaagctgagatgtgagaatcacttgaatctgggagatggtggttgcagtgagccgagatcgtaccactccactccagcctgggcagctgagtgagacgtccc

SEQ ID NO: 40307 - DNA, 423 bp, Homo sapiens
  misc_feature 410: n = A,T,C or G
gcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaagggatttggttataagggttcctgctttcacagaattattccagggtttatgttgtcaggggtggtgacttcacacgccataatggcactggtggcaagtccatctatggggagaaattttggaagatgagaacttcatcctaaagcatacgggtcctggcatcttgtccatggcaaatgctggacccaacacaaatggttcccagtttttcatctgcactgccaagactgagtggttnggatggcaagatg

SEQ ID NO: 40308 - DNA, 470 bp, Homo sapiens
cacacaaggaagcactggggtggagcaagaagctgagagaggggtaagtataggtgaggtggcataagcatgctgaggactgtttcgtttggatgaatttcagtgggctctcgagcaaaggggctttccctacttgtctggcacctagccctggggtgattagggcaggtggataatggccaggcgtgtaagagcccaataaaggagatggttggggtgtgagctctggattggttgatttgtatttggaaagcacacttgggggcaaatgttttaatattcctaagagctgactagttctggaaggggcagtccctccagggccaggcaagctccaatcaaagcatcagcgtagagggaattggaagacatggctaaaacacgaaacctccacagcctggcctcactgaatatctagtctcatctccctctcctctcggaaatggactctgggcctgaaggagttccag

SEQ ID NO: 40309 - DNA, 413 bp, Homo sapiens
gtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaaggaggacagttttaatgattgtacttgcatgaacacaatcatatgatggtaaagcagaaacttaagaaaaaattgtttatgtgttatattcaattagcttaaataagttgctttgttatatttttat

SEQ ID NO: 40310 - DNA, 223 bp, Homo sapiens
gttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattaca

SEQ ID NO: 40311 - DNA, 378 bp, Homo sapiens
atatcagctctgcaagatacatagatatccccattttatggtgacggagactgaggcttagagaagttatgcaacttacctaagttacacaccttccaagcagcagagccagcattcgaacttagacccatctgactccaaagccagtgccctctacactagaccacactgtctttcttaggttggatctaaaaaaatactaccagctggttggttttttaactaactgtaggaacacaacctagtattaagtagagtatgcatgctgcatagtggactgaggtagagtaaaacccattattgtaccacttttaggtaagaaaatgtattatctaaggaatatcattaaaatttccttacttccctccatgaacaaac

SEQ ID NO: 40312 - DNA, 165 bp, Homo sapiens
atacttctacataataaagtccccgtagagcaaacccatggctgacatactgaatggagaaaagaggaaagcctttcctttaagaagtggaataagacaaaggatggccactttgaccattcctattccgcatagtactagaagttctaaccaaagcagtcagac

SEQ ID NO: 40313 - DNA, 122 bp, Homo sapiens
ctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 40314 - DNA, 174 bp, Homo sapiens
caagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctatt

SEQ ID NO: 40315 - DNA, 145 bp, Homo sapiens
acgataaagtttgcacagtcttacttctgtagaacactggccataggaaatgctgtttttttgtattggactttaccttgatatatgtatatggatgtatgcataaaatcataggacatatctgaataaagcaattagcaaacca

SEQ ID NO: 40316 - DNA, 114 bp, Homo sapiens
agagcaggaaacgtagggggcggccacaccaggccttttcagagccatggaaatgtgagggaaaggctgtggagggagcttctttcccctgccccgcacacaacctagagatgc

SEQ ID NO: 40317 - DNA, 235 bp, Homo sapiens
ctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 40318 - DNA, 384 bp, Homo sapiens
tacaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaattactaatcagtttaataaaaacattttgtctattccc

SEQ ID NO: 40319 - DNA, 254 bp, Homo sapiens
agtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctccc

SEQ ID NO: 40320 - DNA, 260 bp, Homo sapiens
atagttaaaaacaaagtagaaaatatgtgatctattacaaatactggcaattagtttttaatttggatagttcataaattttcagatgaagattttacacaacatagacttgtttatatagctttacatatttgttttctaatgctattgtgaactgttgttaatttgtatactcatttctcttcattaatttatgggaggataagattgaaaataggtaacattttaaagtagctatcataaaacataaaatttttttc

SEQ ID NO: 40321 - DNA, 299 bp, Homo sapiens
  misc_feature 7: n = A,T,C or G
ggcagtncagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttatttttttttctctctctctctcttaagaaaggaaaatatcccaaggactaatctgatcgggtcttccttcatcaggaacgaatgcaggaatttgggaactgagctgtgcaagtgctgaagaaggagatttgttttggaggaaac

SEQ ID NO: 40322 - DNA, 380 bp, Homo sapiens
aggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgttggttgatgattaatttgcgagactaactttgagagtgtaacagttttgaagaaaacattgaatgttttgcaaatgaaggggcttcacggaatgttacaatgttactaat

SEQ ID NO: 40323 - DNA, 296 bp, Homo sapiens
gttgagggaaaagaagaaggagaaaggttatcagtccttggatgttgggggcgtgggggtggtcagagtttaggaaggagtacagtagaagaaaagtaagatgggaaggcattggcctactcacctgctttccagtttgggctagaagcagtctcaggtatgagaaaagaacatgaaagggctacagaaaagaactgagaaggaacagtgtgcaggtgagaattcagttttgactctccacgtcagcacgagtttggccaatgatgaaatggcgtaatgagtgaaaatcccttact

SEQ ID NO: 40324 - DNA, 114 bp, Homo sapiens
tgaaaactgaagtttggaacagtcattgctgactttctgaccaattaataatggagaacttgaatcacttaaaagaagcccaacccatagatgtcaggcttaacacaaaaccag

SEQ ID NO: 40325 - DNA, 472 bp, Homo sapiens
  misc_feature 8, 412: n = A,T,C or G
atcccttnaatttacctcttctcctcagaggtatcccattttatctcagcttcccagtttgacatcataaaataatctttggttccaccaggtttctcatttctcacatccattcagctactaagtccttttgattattctttttggagtttttcatattcctctaatcttctccattgctctagctttgcctcagagctggacaactgaaagagccttttatctgataatctcttatgatcggagagttagtatcaatgggtttacggctagtaaaatgagataactgggtatctcatttgaaaaatggggccccagaggcacactagatatctctcattgatatcttcccaagttaaaccaggataaactggatatcccaattctaattttcctgctctttatatgaagnaaggatgtctgcctttcctccagtatattttgttcactgtaactgagttcatttaattta

SEQ ID NO: 40326 - DNA, 361 bp, Homo sapiens
  misc_feature 2, 3, 42, 210, 213, 256: n = A,T,C or G
anntggtcggggcgggcagtggtgccccttcctgcagaagantcctgcagcagtagcgctggcgcccatctgcaggagctggcgggctggccttctggacccctggcttctccccactgtaacgcctgttacacacaaactgttgtgggttcctgccaggcttgaagaaaatgatctgaattttttcctccttttggtttatttttgggnggnttattttagagttttcttttctcctttttggggggtattcaanagtgggctgggcccctgggcgagacacagctacctctgttggcgtctttttaataccaggaacccagcggctctagccactgagcggctaaatgaaataaagtgg

SEQ ID NO: 40327 - DNA, 232 bp, Homo sapiens
cagaacaataaatgtctatcctaatttagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatactgtattcctgcctaaataaatcatctattaatca

SEQ ID NO: 40328 - DNA, 425 bp, Homo sapiens
  misc_feature 258, 348: n = A,T,C or G
atatgaaagccttagtttcttacaaattcctatgaccacatcaatttaagtactgcatgtgaaagccacaatacaagcgactaacatatcaaataggagaatggtccaaccagaatggcttcactggccactggcagcctttcagcagatcagtattagttcatttatttgtattcacctttaataatgatatgctatgaaaaaccttagcataccatcagtcattctaaagggaagactgcttttgcatggtgtctnggctgtgtaaactactgataaaagaacacagtattcagccatgcttttcagaccagcaaaacaatttaatagaattgatattgggggganggatcttaccatcatcaacagcatttttgacagccctcaagccatcccttactgcatctttgatctaagtgtgggct

SEQ ID NO: 40329 - DNA, 142 bp, Homo sapiens
cttgccttggttgtctggcaaggactttgtacctttgggagtttttatgagaaacttaaatgttattatctgggcttatatctggcctctgctttctcctttaattgtaaagtaaaagctataaagcagtatttttcttgac

SEQ ID NO: 40330 - DNA, 434 bp, Homo sapiens
  misc_feature 9, 27, 41, 55, 59, 60, 70, 91, 92, 104, 133, 145, 425, 434: n = A,T,C or G
tctgaaacntgcccctaccccttttanaactgaaaagtganggtacccgccaaangaanntctgcagcantcctcagactcatctcagganncacttaagcacntctgctccaagggtgggttttcttccctntaccttgcaacnggactccttgaggcacctttttagaattagtgagccgctaggatttttatactatgctttgacataaaagaaagttgcttgtcaatatgtgtttttttagtttaccagcatatcagatctcacaaacaaattttaggctcggtttggatgtttctagtaaaaacaagaaaatccaggcatcactaaaagaatcagaaatacgttgtggctttgaaaggtgcaaactaaataatatagctagcagtaacggtcaccaactcctgcttttctttggttcagngatagaggn

SEQ ID NO: 40331 - DNA, 489 bp, Homo sapiens
  misc_feature 17, 18: n = A,T,C or G
gggttcacaaatctttnntgaattattaaacctgtccctcctcctgggttgccaacttagtctctcaggctttgaagttctgtatgatctctgtctcctaaattctatcagttcccaaattgtatagactcccaaacaaataacagctttcaaatacaactttttctatattcccactactagttcactggtttttcattgcttccctcttataccaaagctaatcgttcctgtttcctccattttcaatctctctgttttcccatctctgctaaatactgctgacagataaaatattccagaagcatagaacttacaacatcgcttccttagacggacatttttaaacctcttccatatctaaagaataaactacaaccttctttgcattataggtactctgaaatgggagtccttaatcccttttctggtaaaggacctacagattgtctattattctttccatttctctgcaattgtatataattc

SEQ ID NO: 40332 - DNA, 384 bp, Homo sapiens
  misc_feature 4: n = A,T,C or G
gatngaagtaatttgtgcaaaatttggctttatgcctttattgtccggtatagtacccactaaccctatgtggctatttacatttaaattaattaaaataaaatcagggctgggcatggtagctcgcacctgtaatctcagaggtgtgaggctggcagatcacttgaggtcaggagtttgagaccagcctggccaacatggtggaaacactgtctctattaaaaatacaaaaattagccaggtgtggtggcaagtgcctataattccagctactcgggaggctgaggcaggagaatcgcttgaacctgggagtaaaaaggttgcagtgagccgagatcataccactgcactccagcctgggcgatagagcaagactctgtccca

SEQ ID NO: 40333 - DNA, 476 bp, Homo sapiens
  misc_feature 4, 35, 36: n = A,T,C or G
tctngccggggccttttttttccggcgttcaaganntcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatgggtgatggccacagtcaagaaaggcaaaccagagctcagaaaaaaggtacatccagcagtggtcattcgacaacgaaagtcataccgtagaaaagatggccgtgtttctttatttttgaagataatgccaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 40334 - DNA, 169 bp, Homo sapiens
  misc_feature 2, 81, 117, 120: n = A,T,C or G
tnttggtgggtattgtcttgacagtggatcacaaacttggttcaatgggtagccctcaccatgaaaatcacagcttcagantcactgtcatctcagcaaaacttaaggaaaataagnganttgggtttggaccaagtccttacgtagaggtcacagtagatggacagcc

SEQ ID NO: 40335 - DNA, 442 bp, Homo sapiens
  misc_feature 27, 35, 36, 37, 38, 39, 41, 58, 61, 74, 84, 90, 93, 106: n = A,T,C or G
ccccggggacctcggcccctccggccnggggaacnnnnngncctctggctgcagttcnganccctgtcttaccnggggacctcngagacngantcagggcaacagntagggggatttgtctagtactttaagtaagactcagtctagggtgatagcagaagacctgaagacaatttgatagattttagtgatatttaaatagtgaaattaactgaaatttgtaatatattcaatataggggagttgaaagacaaggaagagtcaaggatgatacttaagatttttggcttgaggaattgagtagatggggtaccattcaataacattggacactgaaagaggttagatgtgtggagatggagaagttaaagggtcttcaagatatcaaattggggcaggcacagtggctcatgcctgtaatcccagcactttgggaagctga

SEQ ID NO: 40336 - DNA, 149 bp, Homo sapiens
  misc_feature 16, 19, 75, 89, 90, 110: n = A,T,C or G
tgtcttccagacgccnacntccgcacaaattttccactttaaccaggaaatactttctcctctaaatgcctgaantcactgttggagannctcttacttgtaatctctanttggagattacaatgattaaatcaataaataactgaaac

SEQ ID NO: 40337 - DNA, 335 bp, Homo sapiens
ggccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttacgagctaccgatggggaaggaagaagatcagcactgtggtgagctccaaggaagtggaataagttttcagatggcttattcaaacctccttagagctaacatggatgggctgaagaagagagacaaaaagaacaaaactaagaagaccaaagca

SEQ ID NO: 40338 - DNA, 363 bp, Homo sapiens
  misc_feature 7, 305: n = A,T,C or G
ctaagtnacctgtgttcacacttccactggcaaaaattcagtcacaggaatgtacttagctgcagaggaggctaggatatgccctccaaaaactcaggggggatgtcctacttgtaaaaggaagaaatgaaaaatggacactgagaggaaatcagcagtctcagaggtaatatacttacacagttttttaaaaaacataaaatgatgcagaatgaagtttccactctattcaccatctatccagtcctcatgcctcccaacaagaggtaaatactttattaattgtgtcatggtatctttccagnagtttttctaagcaatttgcaacagatataaatatgtatcccttatttcctaccttac

SEQ ID NO: 40339 - DNA, 461 bp, Homo sapiens
  misc_feature 4, 16, 36, 58, 59, 95, 434: n = A,T,C or G
cacnactctttagaanattcctctgcctgaaggctnttgccacctgtcaaaatcttcnntacttctttgcctctttcctgagcctcttgcttgantgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatgggattccacccctgccttcctaggtgaccttggacaaattctcgaacccattcaccaaccacacaagtttgttggtgagtataaatgggataatgaatatttaaaatgcccntttggaaaataaacattaaaaggttac

SEQ ID NO: 40340 - DNA, 471 bp, Homo sapiens
  misc_feature 21, 321, 323, 325: n = A,T,C or G
ataaaagctaatctctactanattggtcttgcaacagttttaaagcctctgcataattgataataaaaatgcctgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgngngnggagattactctagcaactattacagtataacacagatgatcttctccacacaccccatcacccagataatttacagttctgttaacagtggaggttggataaaagtattactgataaaaaaattattctaaagggaaaaaaacag

SEQ ID NO: 40341 - DNA, 500 bp, Homo sapiens
  misc_feature 2, 6, 33, 46, 428: n = A,T,C or G
tntttngccgggggaacccacgcctgcttgagnctctggacctgcntcctaccaccaactcgtccaactgacaagccccttgcgccctgcctctccaggatgtctacaaaattggtggtatttggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgttgtctgtcaaaggatgttccgtcgtggcaacgttgctggtgacagcaaaaatgacccaccgatggaagcagctggcttcactgctcaggtgattatcctgaaccatccaggccaaataagcgccggctatgcccctgntttgggattgccacacggctcacattgcatgcaagtttgctgagctgaaggaaaaagattgattcgccgttc

SEQ ID NO: 40342 - DNA, 442 bp, Homo sapiens
  misc_feature 19, 21, 25, 30, 427: n = A,T,C or G
tatggccgggcctcttganangaangagtnagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggggtttatgtgaacattcctatcaatccaaattccctctggagtttcatgttatgcctgttgcaggcaaatgtaaagtctagaaaataatgcaaatgtcacggctactctatatacttttgcttggttcatttttttttcccttttagttaagcatgactttagatgggggaagcctgtgtatcgngggagaaacaagaga

SEQ ID NO: 40343 - DNA, 303 bp, Homo sapiens
  misc_feature 4, 8, 26, 28, 39, 54, 56, 110: n = A,T,C or G
gganttancctgcacccctagacccnancggaccctacnagactctttctagancnctttcaattcctggctacagaaataaacatttcttttcctcagcacttggctcnttctcaaggataggcaatatattaggccacaaatcaagtgtttaaaaattcaaaatatattgaaataatattgcatatcttctctgaccacaatggaataaaactagaaataaataacaagaggaactttggaaactatacaaacacctggaatatgctcctcaatgaccagtgagtcaatgaagaaattagc

SEQ ID NO: 40344 - DNA, 155 bp, Homo sapiens
  misc_feature 68: n = A,T,C or G
agtaagaaaaacattattgaggaaaattaatatcacagcataaccccaccctttacattttgtgcagngattattttttaaagtcttctttcatgtaagtagcaaacagggctttactatcttttcatctcattaattcaattaaaaccattacc

SEQ ID NO: 40345 - DNA, 113 bp, Homo sapiens
  misc_feature 3, 13, 31, 35, 53, 70, 73: n = A,T,C or G
gcnagctgggaangtacacgcctgtgtaatnaganaccttctcgacaagtacnagctgatgtttctcacngtngccttaccacttctctgagccactctttgctgttgatttg

SEQ ID NO: 40346 - DNA, 437 bp, Homo sapiens
  misc_feature 4, 332, 344, 357, 375, 423: n = A,T,C or G
gagnggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtgggtatgcanatcttcgtgaanaccctgaccggcnagaccatcaccctggaantggagcccagtgacaccatcgaaaatgtgaaggccaagatccaggatnaagaaggcatccct

SEQ ID NO: 40347 - DNA, 442 bp, Homo sapiens
gctttccacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatggaaagattcaccaaataagctatgtacttttggttacctatgtacctgttaccactttcaaaaatctacagacagtcaatgtgggatgagaactaatcgctgatcgtcagatcaaataaagttataaaattcc

SEQ ID NO: 40348 - DNA, 342 bp, Homo sapiens
  misc_feature 11, 20: n = A,T,C or G
tggcccggganaggtagaantgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgttttttcggacagtttatttgttggagaagtgtgaccaaaagttacatgtttgcacctttctagttg

SEQ ID NO: 40349 - DNA, 140 bp, Homo sapiens
atagctgatcagttttttccctggaagcatttgtttctactttgatatgactgtttttcggacagtttatttgttgagagtgtgaccaaaagttacatgtttgcacctttctagttgaaaataaagtgtatattttttca

SEQ ID NO: 40350 - DNA, 271 bp, Homo sapiens
  misc_feature 23, 239: n = A,T,C or G
tcttaacgtgaaccgtctgttcnttgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtactntcgattagtaaaagaaaaaaattttgaatgtt

SEQ ID NO: 40351 - DNA, 386 bp, Homo sapiens
cagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgtaaaaattggtctaggcttgttacaacaaaattagtttgtatccttgggttattaaacagtatct

SEQ ID NO: 40352 - DNA, 416 bp, Homo sapiens
  misc_feature 5, 8: n = A,T,C or G
aaganttnacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggtttttaagtgcttgtggctcactgaagcttaagtgaaggatttccttgcaatgagtagaatttcccttctctcccttgtcacaggtttaaaaacctcacagcttgtataatgtaaccatttggggtccgcttttaacttggactagtgtaactccttcatgcaataaactgaaaagaac

SEQ ID NO: 40353 - DNA, 436 bp, Homo sapiens
  misc_feature 417, 418: n = A,T,C or G
gctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggttgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaaatgtatggcttatgtataaacattgtatggnnaataatggctttctattg

SEQ ID NO: 40354 - DNA, 500 bp, Homo sapiens
  misc_feature 6, 7, 41, 44, 454: n = A,T,C or G
tcggcnntttttggccggggcagtaggctttaacgacagantantttgtgaatacttgctaagatattaggtgagcattgccacaatgtcacacacacagtttgcaagtaacagagagtttgggaggcagacagttgagagagaggtagcaaaatgttaatgactggtaattggtgagtgcaggtaaaggatatatgagtgttcattatactattcttagcaacttttctgtacgtttaaaaacatttttttttaagttgagggcatcactaatcatgagagaagtgcaaatcaaaaccgcaatgagataccaactcacaccagttgaaatggctattattaaacagtcaaaaaacaacagatgctggcaatgctgcagagaaaaaggaattcttaaacactgttggtaagaatctaatttcagtttagccactgtggaaagcagtttgggganaagttctcatagactttaaaaaaagaaccactatttgaccctacac

SEQ ID NO: 40355 - DNA, 113 bp, Homo sapiens
  misc_feature 78, 106: n = A,T,C or G
atatagactctggtgttctattgctgagaagcaaaccgccctgcagcatccctcagcctgtaccggtttggctggctnggttgatttcaacatgagtgtatttttnaaaattg

SEQ ID NO: 40356 - DNA, 256 bp, Homo sapiens
gtggtcctccctgaaataacgcattcgaaatcctgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatac

SEQ ID NO: 40357 - DNA, 248 bp, Homo sapiens
  misc_feature 5: n = A,T,C or G
agacntgtacaactaatactctacccaaactggttttacaatgctgaaatgcaaatttacctcctgagaatatgaagagagggtttacacacctcaaaaatcaaatgctgtttatacctgagctatatgacagctataggactcaagttataagcaataagagccaataaattaatactggtgaaaagggacttttctgaaaatactttgaatactagactatgcaagaaacccagcaggaatgtagg

SEQ ID NO: 40358 - DNA, 323 bp, Homo sapiens
aggaaagggcaattgagaaaatgacagctgcctttcattgtattaagttgattcattcaacaaatatttgttgagcaaatactatgtataaaacagggcatgaagagtcatataaaacagaaaaatatgacttagttcgtgtcctcaaagaagttaaaatctggggaggcagaaagcagcattccaaagaactaaatgtgctcatcggcatttgagggctggatatggtggctcaagcctgtgaccccagcactttgggaggccaaaatggtaagatctcttgaccccagtagtttgagagcagcctgggcaacatagcgaga

SEQ ID NO: 40359 - DNA, 248 bp, Homo sapiens
gggtgtggggagcagtgggtcaggaagtgggagccagaggtttgactcactttgctttatttttcaggctacaatacaggtcagagacaatggcttataaaggtttagcgtggtctcaggatgtgacaggcagtccagcctgacctttctgcacactccagacaaacttcccagacaagctcctttgtgcctctacgtggagagggcgtggaaagttatcacattaaaagatgggagggatttgctct

SEQ ID NO: 40360 - DNA, 259 bp, Homo sapiens
  misc_feature 26: n = A,T,C or G
aaccgctttactaaacgcagacgaanaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtgc

SEQ ID NO: 40361 - DNA, 293 bp, Homo sapiens
  misc_feature 15, 40, 61: n = A,T,C or G
agctcttagtaagantacacatgcaagcattccccgttcnagtgagttcaccctctaaatnaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgtttttagatcaccccctcccc

SEQ ID NO: 40362 - DNA, 237 bp, Homo sapiens
  misc_feature 16, 22: n = A,T,C or G
ctactgaaaataagantctgantataaatttgttttctcaaatatttgctatgagaggttgatggattaattaaataagtcaattcctggaatttgagagagcaaataaagacctgagaaccttccagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 40363 - DNA, 229 bp, Homo sapiens
actcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcta

SEQ ID NO: 40364 - DNA, 363 bp, Homo sapiens
gtctattattctgttagttacagtcctaaccaagtaaacatgaagcacagtttgttttttctgagagtgttcttttctcattattaggaagagagggagatattttacccaattttatcttttttcaaaagattaaaaatataatttgttgaaaaatacctatgtagaacatacatcagacacagttcatactgtgttttgagagtatcttcttcctcattatcaggaagaaaaagattttttaccctgtttatcttttttaaaaagttactgtaaaaatactgtttattattcaaacagttatataatgttagacttttttttttctaattcgccaacctttcgtagtatcctctgcatttg

SEQ ID NO: 40365 - DNA, 176 bp, Homo sapiens
  misc_feature 4, 7: n = A,T,C or G
gctnttnttagaaaaagaacagaaacatgagttaaatataactatgatgtttcctaatctcagaactattattaacagttttttattcattttagattcaagggtacctgtggagttttgttacatatatttattttataatactgaggtttgggcttctgttgaaaccatcacac

SEQ ID NO: 40366 - DNA, 146 bp, Homo sapiens
  misc_feature 3, 41: n = A,T,C or G
tcncctgtggagcagccttctatctacctgactcctgagcnggctgccgtggtgtcatttctgtcattccgtgctctgtttccttttggagtttcttctccacattatctttgttcctggggaataaaaactaccattggacctag

SEQ ID NO: 40367 - DNA, 214 bp, Homo sapiens
ggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatacttcc

SEQ ID NO: 40368 - DNA, 364 bp, Homo sapiens
  misc_feature 271: n = A,T,C or G
ggtaaacttggctatgattttctgttgggccaactccccatgcccctgagaaacacattcttcacaaaaataattgtaataggccgggcgcggtggctcacgcctttaatcccagcactttgggaggccgaggtgggcggatcacaaggtcagaagatcgagaccatcctggctaacacagtgaaaccccgtctctactaaaaatacaaaaattagccgggcatggtggcgggcacctgtagtcccagctactcgggaggctgaggcaggnagaatggcgtgaacacgggaaggaagagcttgcagtgagccaagatcgtgccactgcactccagcctgggcaacagagcaagactccatcccg

SEQ ID NO: 40369 - DNA, 347 bp, Homo sapiens
  misc_feature 35, 324: n = A,T,C or G
caagtgaaacattcaatgctttggcttccaagaangacaatgagcaacactgtgttcaaagtcaaggattattggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtangaggggagaaagcgggacctgga

SEQ ID NO: 40370 - DNA, 391 bp, Homo sapiens
atctattggaggacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtgggttttgatcttttcaaaccattttctttttgaaaaaaggcattagttgtagtcatggacattaaatgggccatatatgcttatcaatcaaaaaagtgttccttttttggaactgcccattttctggatcttccctctcaatggtgggggggatgaaaaccttgggttg

SEQ ID NO: 40371 - DNA, 260 bp, Homo sapiens
  misc_feature 107: n = A,T,C or G
cgcaggaactgtgtgtgtcctacacaatggtgctattctgtgtcaaacacctctgtattttttaaaacatcaattgatattaagaatgaaaagattattggaaagtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 40372 - DNA, 468 bp, Homo sapiens
ggcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgaggactacgagcgtctcctgaagatgcaaaaccagcgtggcggccgcgctctcttccaggacatcaagaagccagctgagatgaaat

SEQ ID NO: 40373 - DNA, 281 bp, Homo sapiens
  misc_feature 44: n = A,T,C or G
gtacaggaaaacgtggctgagaagacctcaggaaacttataatnctggtaaaaggggaagcaggcatgtcttaaatggccagagcaggaggaagagagagaagggggaggtgccacacacttttaaaccagatctcatgagaactcactatcacaagaacagcaagggggaaatctgcccccatgacctaatcacctcccaccaggccttacctccaacactggggattacaattcaacataagacttgcatggggacagaaatctaaaacatatcagagg

SEQ ID NO: 40374 - DNA, 467 bp, Homo sapiens
  misc_feature 457: n = A,T,C or G
cagaatactattagaatctgatgaagacagacttcttgttgtatttaaccgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtttagatgtcctcaaggaacttgtactttttgagtccccatgattttcttcatactctggttccctttctacaacacaaccattgtacttaccatcacagtaatataccaatgtctcttggaccttatttcccttgtcgagaaaatatcaagcnataggagggg

SEQ ID NO: 40375 - DNA, 361 bp, Homo sapiens
  misc_feature 341: n = A,T,C or G
cgacagtactggggaaattatttctgttagaatggtaggccctttagaaattttaccatgattttttgttttaaaagtatctgtacatttataagaacaaaactgattttgagaggcaccctcctctatcactagtatataattcaggaataaaaagaaggccaaattataaactatggagtttatattatctgcagtcatatcaaataatatgaccaaataaaataacttgtgaatttcctaaacataattaatcacattgattaatgacctgaattaactgcttgaatttagtcaaatttgttgaagcaagtagtcccaagctatgttttgagtttagnattctgggttttttcattat

SEQ ID NO: 40376 - DNA, 436 bp, Homo sapiens
taattttctttctgttgattgggatggggatgtaatatgctgtatcctttctcccattccctgcttatccccaaatggtgcatatttttatttctttagggaactcaagtagaaactagactcccagattcttaataggatcaggaaatgactgataactttttccagcttttcccaaattgatatgcatatctcttctgtgatagtgtcctcccaaggcacagagggcccaaggtcacacgcctgccactggcattggaaacctctgtgggtaccacttgtcacagtcatgaggctgcaggactactctgactctcagtggaccccttctctatagcaaatagacagtgatggcattgggtctggccaatatatgaatcttaagattcttacgagttaattacctgttaaaagaaagctaggagggtgataaaga

SEQ ID NO: 40377 - DNA, 470 bp, Homo sapiens
  misc_feature 22, 24: n = A,T,C or G
gagccccccggaagaaaccggnanaggaagccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaatacaaggaagctgagccttcacaaggtcgaacaacacatttgatgccatgcaactgagaaagtggttcaagctgggatttgaacaaatgtaagtcagactctgcagcctat

SEQ ID NO: 40378 - DNA, 328 bp, Homo sapiens
  misc_feature 50: n = A,T,C or G
ctatgacaatgactagcactcaactttggtcattctgctgtgttcattangtgccaatgtgaagtctggattttaattggcatgttattgggtatcaagaaaattaatgcacaaaaccacttattatcatttgttatgaaatcccagttatctttacaaagtgtttaaagtttgaacatagaaaataatctctctgcttaattgttatctcagaagactacattagtggagatgtaagaattattaaatattccatttccgctttggctacaattatgaagaagttggaaggtacttcttttagaccaccagtaaataatcctccttc

SEQ ID NO: 40379 - DNA, 221 bp, Homo sapiens
gagaatggtatatttgaagtgttactttcaagctgatatgccttctgaagaacttgtgtgagatcaccaagaatagttaatgtttatgatagagaaaacaccaccgggcgcggtggctcacgcctacaatcccagcactttgggaggccgaggtgggcggatctcttgaggtcaggagttcaagaccagcctggccaacatggtgaaaccctgtctctact

SEQ ID NO: 40380 - DNA, 402 bp, Homo sapiens
  misc_feature 9, 190, 288, 300, 327, 330: n = A,T,C or G
tctaagagntaccttatttttctagataagcaaatatatatattagaaaagttttttgtatcaactaattattgctagatagattaagtaaataaactattgcacagtggttataagaagtatccattgagaacagaggctctgtaactatccgggtctggttagtgtcttttttgggttatcattaggngtcagtttttcaacacctatatttttctttggaaaaagaaacatcccgtcagaaaaggggccctatgacatgaagtctctataactatcctatttggngggttttttcangctgtcattagatgtagacttttctgnggnatttacccttaacacctgtactttctcttttttctttgaaaataattgtcttttttgccacttattgaaatg

SEQ ID NO: 40381 - DNA, 297 bp, Homo sapiens
ctgcatatgttgagccaccttgcatcccaggaataatgtgtagttaatcatggtggattagctttttgatgtggtactggatttggtttactggtattttgttgaggatttccaaatccctgttcatcatgaatattggcctgaagtttcttttcttattgtgtctctgccaggtttctgtataaaaatgatactggcctcataaaatgaggttaagggaggagtctttcctcctaaatcttttgtaatagtttcagtaaggatttggtagtagcctctttgttatacatctggtag

SEQ ID NO: 40382 - DNA, 408 bp, Homo sapiens
  misc_feature 176, 407: n = A,T,C or G
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctngggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatcgagacatgtaagcagcatatgggang

SEQ ID NO: 40383 - DNA, 315 bp, Homo sapiens
ggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcact

SEQ ID NO: 40384 - DNA, 378 bp, Homo sapiens
  misc_feature 21: n = A,T,C or G
gtgtgttcaacgactgccgtnacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtg

SEQ ID NO: 40385 - DNA, 294 bp, Homo sapiens
gcaagcaacagcgacgcgagtatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaat

SEQ ID NO: 40386 - DNA, 382 bp, Homo sapiens
  misc_feature 44, 53: n = A,T,C or G
agcaatatataacacagtatatgcttttttatatattcaatgtnagcccaagnctgaatttacattgtgactaaaggcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtaca

SEQ ID NO: 40387 - DNA, 320 bp, Homo sapiens
  misc_feature 6: n = A,T,C or G
gtctgngcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaac

SEQ ID NO: 40388 - DNA, 295 bp, Homo sapiens
aataccaagtgttgttggaaatttattactaaaaataatgaaatctgatctcagactttcagaaaaaacataattggtcttgtgattcaggtaaataattttaacttctcaaaggattcagtagttggggtgaaatattttcagtgaatttctacttgaaacaagagtaaaggtagacctggcacaatggctcatgtctgtaatcctagtaacttgggaggcccagcgggggacgatcatttgaggctaggcgtttgagaccagcttggggaacaaagtgagaccctgtctctac

SEQ ID NO: 40389 - DNA, 194 bp, Homo sapiens
  misc_feature 7, 8, 29, 43, 91, 114, 139: n = A,T,C or G
aaccctnntttgggaacaagagagttttnttcttttttagatnaaaccattctgtaaaatctttgttgtttaattaaatgtgccgttattnacccctgatgttatttatgactntgtgccgattcctgctcgggctgtntgctgttggctggtaataatatatttgatttaaatgctgtttgactgtgctatta

SEQ ID NO: 40390 - DNA, 174 bp, Homo sapiens
  misc_feature 31: n = A,T,C or G
caagcactgtatgtgttcatgaagtcttaantagagaaacacctgtttccccattgcttctctctccttccccacacccctgcacctgccccaaccccaggcactagagggaacagtaacagagggagattggcactgcattgccagtacttcacccatctatacccctccacc

SEQ ID NO: 40391 - DNA, 318 bp, Homo sapiens
  misc_feature 16: n = A,T,C or G
gaagcatcaacatggnaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatg

SEQ ID NO: 40392 - DNA, 332 bp, Homo sapiens
  misc_feature 1: n = A,T,C or G
nattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccca

SEQ ID NO: 40393 - DNA, 343 bp, Homo sapiens
agaagcgagtatgacgaagggaacgtcatcgcttggaaagcgtcgcaataagacgcacacgttgtgccgccgctgtggctctaaggcctaccaccttcagaagtcgacccgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttg

SEQ ID NO: 40394 - DNA, 116 bp, Homo sapiens
  misc_feature 32: n = A,T,C or G
ctctactattactggtgcatagctggcctaantagcttgtatttataaatctgacagcctacttatatgctgccttcaaagaggtacaactattgcaagatagcgccattataggc

SEQ ID NO: 40395 - DNA, 233 bp, Homo sapiens
agagaggaatccttgtatgtttcccagggtgctctccaacccctggcctcaagtgattctctagcctcggcctcccaaagtgttgggattacaaacatgagccactgcacccggccctaaaatggaattttatgtaactcttacacacaggctgctatgtagctgataaggataaatgttttcagtgtagtgcttgattatttgcttttttcttttcttttcttttctttttt

SEQ ID NO: 40396 - DNA, 112 bp, Homo sapiens
  misc_feature 17, 112: n = A,T,C or G
agtgaaacttttctagnaattatttttcactctaagtcatgtatgtttctctttgattatttgcatgttatgtttaataagctactagcaaaataaaacatagcaaatggcn

SEQ ID NO: 40397 - DNA, 443 bp, Homo sapiens
cacttaccctagttattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcgtattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaac

SEQ ID NO: 40398 - DNA, 345 bp, Homo sapiens
  misc_feature 1: n = A,T,C or G
nattctggaaggtttcataaaaggaagatacttgatgaatttgaagtttgagtaggaatttcattggtgagaataggtaaagacattcttaggacagggaacaaagaagaggactgaagtaaaagagtgtaaaatgggatgataaaatatccactaatcaaatctgatctgtcgggtaggaaagagagatggaaagctaaagaaggagctgaaacagtacactgtatattggttactaaagtttgatagaacagtggtttatttttcttcaaagtgtttattttaggcttagaattagaaatagctcttattagtttacttctttgttactgtgtttctctttat

SEQ ID NO: 40399 - DNA, 195 bp, Homo sapiens
gtggcaggagggtggtatgtctgcagtggtctcctgagaagctgaacgttctgtggcattaagtgtagatggggattgggcacagtggctcacgcctgtaatcccagcactttgggaggccgaggtgggtggatcatttgaggtcaggagttctagaccggaccaacatggtgaaaccctgtctctactaaaaat

SEQ ID NO: 40400 - DNA, 329 bp, Homo sapiens
  misc_feature 1: n = A,T,C or G
natgtgtaagtattacagaaatgagattgtaatatatttataattctctaattggtgttgtcagggacaaagaagctatgtgtattatacctcaaaaatagtctttttttttgttctatacattggtgtctgttatcccaaagttttgtataaactggtccgacactcatttgtatcacattacagatctatttttcatagctaatatactcagtcttttcctttaatgaagttttaaaattatgatttgttagtatttatttttgttagagaaaccctttgtcctattcaagctgttgctatggattcaaccttggaaaggtttcttg

SEQ ID NO: 40401 - DNA, 324 bp, Homo sapiens
  misc_feature 32: n = A,T,C or G
gggtggcggttgctatcgcttcgcagaacctnctcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggattttgaagtcaccgttatcttatttttcatacttttatatgtactcagacttgatcgattaatgaagtggttattttggcctt

SEQ ID NO: 40402 - DNA, 182 bp, Homo sapiens
cacagcaagtgtgctaccgtgcaattttcacttaaattcccactttcttctcattaggtcttttcatttagatctggggcctctgtgcatgcttcagtgtttctattatatttgaaatgtcataaaatagatatgtgggtgattttgtactgggcgattacataaatagtgatcttttctgg

SEQ ID NO: 40403 - DNA, 326 bp, Homo sapiens
  misc_feature 260: n = A,T,C or G
ggggggaacctctaacctaaaggaatggtataacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggngtttcttttattgaacttttaacagtctctttagtaaatacaggtagttgaataattgtttcaaga

SEQ ID NO: 40404 - DNA, 446 bp, Homo sapiens
  misc_feature 30, 442: n = A,T,C or G
gaactcggtggtggccactgcgcagaccanacttcgctcgtactcgtgcgcctcgcttcgcttttcctctgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttgggtcaagtttaaatgactgtgctgcccctttcacatcaaagaactactgacaacgaaggccgcgcctgcctttcccatctgtctatctatctggctggcagggaaggaaagaacttgcatgttggtgaaggnaaga

SEQ ID NO: 40405 - DNA, 160 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgct

SEQ ID NO: 40406 - DNA, 330 bp, Homo sapiens
gaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttatt

SEQ ID NO: 40407 - DNA, 420 bp, Homo sapiens
  misc_feature 16, 23: n = A,T,C or G
ctttttaatcctgtcngcagccngacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatact

SEQ ID NO: 40408 - DNA, 104 bp, Homo sapiens
gtaagagcagtaagcaacttattatatagaagaaatcctcagtaaaattatcaactgatttctcatcacaaaccatggaggccaaaggcagtgtgatgacattc

SEQ ID NO: 40409 - DNA, 403 bp, Homo sapiens
tacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccct

SEQ ID NO: 40410 - DNA, 466 bp, Homo sapiens
  misc_feature 155: n = A,T,C or G
gggaacttattttactttgctcgatttcctgttgattttaattcctctaccagtgctgctgctatcccattatgtttcaaaaattgagagattatgaaagagacttaaatacgtacagtattttaatctatgataagagtggcattttatattangagaagcaaaaggggttagtgagtaaagtatattgggacagtctggaaaaaataatgtttcttacatcaaaacaaatttcagccggaatcaaaaatataatattaagccataaaatagcacaagaaaatacagggcaaatttttatactattggagtaaagaagggctttctaaataatgccaaaaaaccagcatccatgaaaggaaagtatccaaaatttatgcatggaaaaaacaccatgaacaaagtcaaaacacaaaagatagaaaaaaaattgtaacagacgtgacagggctaaattatctaacat

SEQ ID NO: 40411 - DNA, 292 bp, Homo sapiens
  misc_feature 35: n = A,T,C or G
gacttcacagtagtaatgcagttgtcttgacttcngtctgtctgttctgttggcaggtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcat

SEQ ID NO: 40412 - DNA, 421 bp, Homo sapiens
aatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagcaatta

SEQ ID NO: 40413 - DNA, 468 bp, Homo sapiens
  misc_feature 21: n = A,T,C or G
gcagtgtgaaatcttcagagnaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgagggaggttgttttagctctgctaaaaactccagcgcaatttgatgctgatgaacttcgtgctgccatgaagggcctt

SEQ ID NO: 40414 - DNA, 405 bp, Homo sapiens
agataatgacacaatcaaatataaattgcaagtatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgaga

SEQ ID NO: 40415 - DNA, 397 bp, Homo sapiens
gggtggcctttattcggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgcccactgtgctttcaaacatagataaagcatgataaagattattatttaagatatacttgtatttatac

SEQ ID NO: 40416 - DNA, 368 bp, Homo sapiens
  misc_feature 33: n = A,T,C or G
ggtctaaatgtgagtattttagaaacagctgangaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatac

SEQ ID NO: 40417 - DNA, 459 bp, Homo sapiens
  misc_feature 3: n = A,T,C or G
acnatccagaaactactactataattaaactgtgggcaaaataatgtaggatatttttgtagaccgtaaaactgaaattaaagttgttactgatcaattaatgaggtgataattaaacagaaactagccaacctgactgattgtagaccaatacctaaaatttgtttttgcaattcacatcctttgagatatatttaattacatttataacacatggatatttaatataatcttttgtgacagattgacagatcttcactatcattatgtgtaattcctcttgatgtttttgtcattattgcatatatatttgggagagaaataaaaggctgtttccaaggtgatggtgataaagagcaaacttataaaaatggttgcctccttttgtttgtataaaacaaccatctcatttccctctgggaggtcactagaggtatgatagctctgttttgaaataat

SEQ ID NO: 40418 - DNA, 461 bp, Homo sapiens
  misc_feature 31: n = A,T,C or G
ggaaccgtcatgggacttcagcatggcggtntttgcagatttggacctgcgagcgggttctgacctgaaggctctgcgcggacttgtggagacagccgctcaccttggctattcagttgttgctatcaatcatatcgttgactttaaggaaaagaaataggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattg

SEQ ID NO: 40419 - DNA, 468 bp, Homo sapiens
  misc_feature 7: n = A,T,C or G
gagctgntggtgtttacagcaagcatggagatctatggctctgctgtggcagataaactggacaatagcagaagtattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctgactgggacacaggcggaagcctaggagagccgaatcagtgtttgtgaaagaaggcaggactggccagagtgacagacatacggtgatccaggaggctcaaagagaagccaag

SEQ ID NO: 40420 - DNA, 326 bp, Homo sapiens
  misc_feature 6, 14, 29: n = A,T,C or G
gggaanaaaaaatnacttttgaaactcgnacttcagtgtatacccaataatttaaaattatgtgaaatgttttaaatttgtgaactcgtaattactgttttaatgattcagtttcttcagagtggtaattgtataaaattgctattgcagctttacattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgc

SEQ ID NO: 40421 - DNA, 377 bp, Homo sapiens
aatgagcaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccccataaagacaaaccaatcaaccatgacaaaggaagttgacctgaacatgtaaccatgccctaccctgttaccttgctagctgcaaaataaacttgttgctgacctgct

SEQ ID NO: 40422 - DNA, 354 bp, Homo sapiens
  misc_feature 10: n = A,T,C or G
aacatcaggnaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatg

SEQ ID NO: 40423 - DNA, 411 bp, Homo sapiens
  misc_feature 6: n = A,T,C or G
gggaantccatccccatgatccaatcacctcctaccagatccctcccctgacacccgaggattacaattgaacatcagatttgcatgggtacacagtgccacacactgtgtcacattgtttctgtatttcttttttctacattccctttcatactgtattcaattttttaatggaaaatgttaatttctactcaaataattgttaccatttcctctcctaaattcttggatgctttgtagtttccatcactgaatattgtcagctcttttcttatgcactgtatttttttttatcatggcaaagaaattgaaattgtggttctaatagcatctctagaagaatacagtggcaggctctggaagggagaagtaggtagctgggcatgtgtaagggggagtgttactttttat

SEQ ID NO: 40424 - DNA, 423 bp, Homo sapiens
gctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatgtgtggccgagtgtaacaaccatataataaatcacctcttccgctgttttagctgaagaattac

SEQ ID NO: 40425 - DNA, 429 bp, Homo sapiens
  misc_feature 7, 32, 33, 34: n = A,T,C or G
gctttcncgcaacgggtttgccgccagaacannngtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctctggctgactgtgctgtcctgattgttgctgctggtgttggtga

SEQ ID NO: 40426 - DNA, 391 bp, Homo sapiens
acctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgc

SEQ ID NO: 40427 - DNA, 456 bp, Homo sapiens
aaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtgtgaaggcttttggtctccctgggagtgggtggaggcagccagggcttacctgtacactgacttgagaccagttgaataaaagtgcacac

SEQ ID NO: 40428 - DNA, 386 bp, Homo sapiens
  misc_feature 16: n = A,T,C or G
atggccgggatgcttnaaaaatttaaaatatttttgaagtcttagattttttctgtattaaaaaagtaatcgttattttttgtttaaaacataaattaaaacatagaaaggtgctgggattacaggcgtgagccactgcacccagccctatatgaatgtttttatatagtctgtaagttattgtttattcttcttttttgctattaaaaacgtacagtctcctctaaaaagaagtcatccatcccaaagacatcagtattcctagaagcatagttttatttttactaattcagatacctgtatgttttatattagtttgctaaattattttgtctaggcaaagcttaaggcagctacttagaaatgtgagaaaggtattttaactg

SEQ ID NO: 40429 - DNA, 240 bp, Homo sapiens
aggtagatggtgcttttttcctccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagc

SEQ ID NO: 40430 - DNA, 464 bp, Homo sapiens
  misc_feature 32: n = A,T,C or G
gaatgtcgtgtattgggagtgccaccacctcntatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacatt

SEQ ID NO: 40431 - DNA, 320 bp, Homo sapiens
ccggcgggtgacattcagccggtggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttat

SEQ ID NO: 40432 - DNA, 167 bp, Homo sapiens
  misc_feature 50: n = A,T,C or G
ggacaagctgcagctgctgcgcctgatgctgggtcagccccgctcccagnatgtaaagaacgcgacttccacaaacctggattttttatgtacaaccctgaccctgaccgtttgctatattcctttttctatgaaataatgcgaatgataataaaacagctttgact

SEQ ID NO: 40433 - DNA, 276 bp, Homo sapiens
  misc_feature 7: n = A,T,C or G
gcaatancttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagagtattttactctttaaaatcctgcctttctg

SEQ ID NO: 40434 - DNA, 356 bp, Homo sapiens
  misc_feature 4, 33: n = A,T,C or G
aacnatacgtagaatgtaaagcttgtctgatcnttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 40435 - DNA, 380 bp, Homo sapiens
  misc_feature 8, 19: n = A,T,C or G
ggattgcnaattatatttnacttaaagggtaattttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatac

SEQ ID NO: 40436 - DNA, 412 bp, Homo sapiens
  misc_feature 42: n = A,T,C or G
tatggccgggagtgtccctgttgctgctactgacccgtgtcnagcctgggacagacgtgggtgagtaagggtggggattggcacaggggtacccgctgcatctcaggctgcaggacaaacccaagacctcactttgtttccaaattctcacacatggctcctgcctccttcctttccctgaggagaggtttccagatgtccaggacaatgcatgtccccaggaagctctggtaagcccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccggcctgact

SEQ ID NO: 40437 - DNA, 252 bp, Homo sapiens
  misc_feature 7, 31, 57: n = A,T,C or G
gtgctgnccatcgacgagaaaggactgaagntgctggggccatgtttttagaggccntacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 40438 - DNA, 318 bp, Homo sapiens
  misc_feature 34: n = A,T,C or G
aagaaaaccgtttagtgtatttagaatgtgtaantttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcat

SEQ ID NO: 40439 - DNA, 334 bp, Homo sapiens
  misc_feature 35: n = A,T,C or G
aagaacgcggtttgcctgaggctgtaactgagtanaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtg

SEQ ID NO: 40440 - DNA, 418 bp, Homo sapiens
  misc_feature 7, 32, 370: n = A,T,C or G
aaatagnaaaagaagaagtcacattctctctntttactggtgatgtgattctattcctcaaaaaccctaaagacttcaccagaaggcttctggaactgataaacaacttcagtaaagtctcagtataaaaagtcaatgtggccgggcacagtggctcatgcctgtaatcccagcactttgggaggctgaggcaggcggatcgactgaggtcgggagttcgagaccagcctgaccaacatggagaaactctgtctctactaaaaacacaaaattagctgggcatggtggcgcatgcctgtaatcccagctactcaggaggttgaggcaggagaatcgcttgaatccaggaagcagaggttgcagtgagcanagattgcaccattgcactccagcctgggcaacaagagcgaaactccat

SEQ ID NO: 40441 - DNA, 133 bp, Homo sapiens
  misc_feature 17: n = A,T,C or G
gatacatttgtaaatcntgggaatgtatttgatggtaattgcctgtggtggttgtatcatgatttaattttattatgagcttttggctttatatatttttctgcctttttatgcattcattaaacagtttaac

SEQ ID NO: 40442 - DNA, 323 bp, Homo sapiens
  misc_feature 33: n = A,T,C or G
atgacactgatgccgaagatgatgctcctacanaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttattttttt

SEQ ID NO: 40443 - DNA, 160 bp, Homo sapiens
  misc_feature 32: n = A,T,C or G
cttccccaaatgttattcatttagaacaaatnaggtatattttttagaatcaactttgtaagcactataaaatctttaataagttataaggtctatgatgtgtttactttaaaaattgctgttaaaagcaacacgtattaaatatgtaattatcatctgg

SEQ ID NO: 40444 - DNA, 279 bp, Homo sapiens
ggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttg

SEQ ID NO: 40445 - DNA, 245 bp, Homo sapiens
atagaacgctactcaacagcaaactgcacactttttccagcatagccagaacatttttcaagatagaccatattctgggtgggaaaataagtcaattaattctgaaggatttaaatcatacaaagagtgttcactgaccataatggaattaaattagaaaggaatctggaaaaatatcttgtaactgaacatcacacttccaaataacccaggggcacatcctgagacattaaaaacatcttaac

SEQ ID NO: 40446 - DNA, 475 bp, Homo sapiens
  misc_feature 17: n = A,T,C or G
gggtggcagctccaaancattggatgctggataaattgaccggtgtgtttgctcctcgtccatccaccggtccccacaagttgagagagtgtctccccctcatcattttcctgaggaacagacttgagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgaagaaagatctttgtgggcacaaaaggaatccctcatctggtgactcatgatgcccgcaccatccgctaccccgatcccctcatcaaggtgaatgataccattcagattgatttagagactggcaaga

SEQ ID NO: 40447 - DNA, 264 bp, Homo sapiens
ataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactg

SEQ ID NO: 40448 - DNA, 433 bp, Homo sapiens
  misc_feature 372: n = A,T,C or G
atggaaaccaatgagcatggctatgtcccaatacaactctatatggacactgaaacttgaatttcatataatatttatattgcaaaatatttttatttttttaaccacttaaaaacctttcttaacttgcaaggccttacaacaatagagggcaagccagattatcctactggtaatagtttgcccatgctttgctctggaccagagaaaactccattaggatcaagtcatcctatgaagtcaggcattccctattgacccatccccaattcccatgtgccaagtgagacttttcctctttaaatttccagagatgggcctgggtgcgatggctcacacttataattgcagcactttgggaaactgaggcanggaggattgcttgagctcagttcgagactagcctgggcaacacagtgatacctcatctcta

SEQ ID NO: 40449 - DNA, 309 bp, Homo sapiens
  misc_feature 7: n = A,T,C or G
aaggganagattttaaaagaaagcagaaggcctgcatggtggctcgcgcctgtaatccaggcactttgggaggctgaggcgggtggatcacctgaggtcaggagttcgagaccagcttggccaacctggtgaaaccccgtctctactaaaaatataaaaattagccgggcgtggtggcgggcgcctgtaatcccagttactcaggaggctgaggcaggagaatcacttgaacctaggaggtggaggttgcagtgtgccgagattgtgccattgcactctagcctgggcaacaagagtgaaactccgtct

SEQ ID NO: 40450 - DNA, 450 bp, Homo sapiens
caccctcagtgcactctatgccggcgccgtagctacctctttctgggaggtatcttgatgtcagccctgagcttgttgcttttgtcttccctggggaatgttttctttggatccatttggcttttccaggcgaacctgtatgtgggactggtggtcatgtgtggcttcgtcctttttgatactcaacccattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtact

SEQ ID NO: 40451 - DNA, 266 bp, Homo sapiens
  misc_feature 33: n = A,T,C or G
aagtaacaggcagaaaagattatatgtcatacntccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaagagcagaataaaagc

SEQ ID NO: 40452 - DNA, 454 bp, Homo sapiens
  misc_feature 58: n = A,T,C or G
gacataatagagatagaaagcacagaaggagcgtggatcggaagagaagggatacttnggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatat

SEQ ID NO: 40453 - DNA, 203 bp, Homo sapiens
agttggagaccgcctgaccacatggtgaaaccccgtctctactaaaaatacaaaaattagccaggtgtagtggcatgcacctgtagtcccagctactcaggaggctgaggcaggagtattgcttgaacctgggaggcagaggttgcagtgagccgagattgcaccactgcgctccagcctgggtgacagtgagactccatccc

SEQ ID NO: 40454 - DNA, 440 bp, Homo sapiens
  misc_feature 21: n = A,T,C or G
aacccaacctcaatctgactntcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttgttttatac

SEQ ID NO: 40455 - DNA, 349 bp, Homo sapiens
gagggcaatggcacttgcaattcaaattcgggaggagagactctgattcctcctttgtaatgcaggcacaactaatgaactcattacagctggcccatatgtgcattgcctattccttggtaaagtgggcagggagactgtagtctgccaacatgcaccctttcgaaggggctatcagtgaagaggtttcacttgtagctgtgtaagtatttctacagtgatggagggtctggggtcagtgctgagtcttcccagttcactgagattgggttgtacaattgggaccagctgtggttagtccattggttgtacttgcatgacactggagtttatgtaaatagctaagtga

SEQ ID NO: 40456 - DNA, 425 bp, Homo sapiens
gaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaactgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttct

SEQ ID NO: 40457 - DNA, 473 bp, Homo sapiens
aatggaatatgtgtatttgtcatataaaataaagaactcataagagttcaattatatacatggctgatatgctgggaaggacaggaaaataattgggaaaactaatgtcaaaacgatagctgagtttttagtaatgaaccatttccctggacttgcattgatgatagtcacaagtagagtagctataatctaaacacttcttactaaaaataagatcctagaatatccatagactgggaagttggccatagatagtgcccagatttatagaaaccaccacagaatggcttttcatctgtatctggtttttaggtgaaacaaggtgtgtttaaaaagcatatactggaaaaagagaaaaaaagaaaaaatctgtagaggaaaaatataaggaagagaagaaaattaccaaaaaagagtactgtaattagtacattttgtgtaatgagatgatctcacgttcagaaaacaagaac

SEQ ID NO: 40458 - DNA, 402 bp, Homo sapiens
  misc_feature 108, 153, 280: n = A,T,C or G
attaatagaaggcatggctcctgctgcaaccgctgtgaatgctgctgagaacctccctctatggggatggctattttatttttgagaaggaaaaaaaaaagtcatgtntatatacacataaaggcatatagctatatataaagagataagggngtttatgaaatgagaaaattattggacaattcagactttactaaagcacagttagacccaaggcctatgctgaggtctaaacctctgaaaaaagtatagtatcgagtacccgttccctcccagaggngggagtaactgctggtagtgccttctttggttgtgttgctcagtgtgtaagtgtttgtttccaggatattttctttttaaatgtctttcttatatggggttttaaaaaaaagtaataaaagc

SEQ ID NO: 40459 - DNA, 222 bp, Homo sapiens
  misc_feature 43: n = A,T,C or G
cagtgacatgtaggtaggaagcactgaaaatagtgttcccagnagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttc

SEQ ID NO: 40460 - DNA, 142 bp, Homo sapiens
attcgagggcggatcctctctggcgtggtgaccaagaatgaagatgcagaggaccattgtcatccgccgagactatctgcactacatccgcaagtacaaccgcttcgagaagcgccacaagaacatgtctgtacacctgtcc

SEQ ID NO: 40461 - DNA, 473 bp, Homo sapiens
aggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcgaggtcttcccccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagt

SEQ ID NO: 40462 - DNA, 318 bp, Homo sapiens
atcatcttaaaaaaattaagatatattaaaagactaaggccgagtgcaggggctcatgcctgtaaccctagcactttgggaggccgaggctgagggatcacttgaggtcaggagttcgagaccagcgtggtcaatgtgatgaaaccccacctctattaaaaacacaaaaattagctgggcctgtgacgggcatctgtaatcccagctacttgggaggctgaggtaggagaattgctcgaacctgggaagcagaggttgcagtgagccaagattgcgccactgcacttcagcctgggcaacagagcaagactctgtctc

SEQ ID NO: 40463 - DNA, 421 bp, Homo sapiens
  misc_feature 1, 256, 386, 407, 418: n = A,T,C or G
naattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgnaaaagaaaaattggaaatgactgctaaccagacctcgttatgaaaccaatgatgaaaaagtcacttggtgcacctctcaacaaaacaggatgctttttccgagttcttgtatatgcaaatcatttacgangcaagttttcaacagacctanaaagcaaaacnttg

SEQ ID NO: 40464 - DNA, 115 bp, Homo sapiens
  misc_feature 3: n = A,T,C or G
gantgtttgaggttttaggattgtgcactttttaagcattagagataaattttgggatgcatcatttcagaagaagatcaaaccatctctcctacagaaataaatcctcaaccca

SEQ ID NO: 40465 - DNA, 471 bp, Homo sapiens
ggtagatttttttccttcgccgtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctggctctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaat

SEQ ID NO: 40466 - DNA, 175 bp, Homo sapiens
  misc_feature 19: n = A,T,C or G
gggaagtccatggagactntaacaaatgtgaagatattccatggatcagaatataaagcaaatggaaaagtaatcagatggacagaggtaaggaaatgaaacttggcatacttgacccactttgagcacaactttttgctaggccaagagccacattctgggttgactttgtagg

SEQ ID NO: 40467 - DNA, 361 bp, Homo sapiens
gaaaggagacccaagttgaaaggcaagcttggtgtgccttgcttagggggacagtcatctgcctggattttctgactttggtaacatgaaatggagccttaagcaggtcggggtcctgttgtgaaacagaaaccaccctagatgaacgtgaaaaagaaaaagaattggtgtttgaagtgttgggagcaacatgggggaaagttactgaaaggttagttaataactgtagggaaaccactaacactgtgtcccctcgtcccatctatcagttgttaagtccatttttaggtgatactaacttcaagttcagtctcacctaactattagatatcttaaggaatacattgtattttatgtaaat

SEQ ID NO: 40468 - DNA, 482 bp, Homo sapiens
gaagagttggtctgtgtgactgatagaatacatcagaaatgatggtgtgtcacttccaagattaggttataaaagacattgggacttccatcttggtctctgtctcttttatggggctgagggtcacttgctgtgtgggaagctggcacttgtaaggagccaaggcctacgccaacagtcatgtgagtaagtaagcatggaagtgggtccaccagtcccagtcatggcttcagatgactacagccctgaccaacagtttgattgcaacctcatgagaccctgagccagaaccacccagctaagcccctcccagattcctgaccctccaaaactgtgagattttttttaatgtttattatttaggctgcctactttgggggtgattggtatgcaggaatagatcatcattacacacccccattaaatctcttcattcttcaaatcttaatatctgttttggggtttttttattatttatactg

SEQ ID NO: 40469 - DNA, 472 bp, Homo sapiens
ggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacat

SEQ ID NO: 40470 - DNA, 274 bp, Homo sapiens
  misc_feature 274: n = A,T,C or G
gaggtgaactattttgtattagcattctgatattcagcattgtcagtgtttggaagaattagaaaacctttgactggattgatttgaaagtttcaaattttactctattttctacactatgctttcctgacttgcttctttgtagaaaaacatgcttgcttttgccttgtggagagggaagctaaagaaagagatttgctggaggatgacaggatggaaggagaataagaagaaaagaaaactaggaataagtgaaatattgaaagggaaggcn

SEQ ID NO: 40471 - DNA, 177 bp, Homo sapiens
  misc_feature 30, 41: n = A,T,C or G
aaagacacctgatcctctacaactgtttantcagttttacnttttgtacagtattagtgacctaagttattttgctgtcccgtttttgtaaatcaaatgaaattataaaagaggattctgacagtaggtattttgtacatatgtatatatgttgtccaaataaaaataataaatgat

SEQ ID NO: 40472 - DNA, 426 bp, Homo sapiens
gacttttctcctgatggagcattactggctactgcctcttatgatactcgagtatatatctgggatccacataatggagacattctgatggaatttgggtgggtacagcatgaattattttagtctataattcatctccacctatcaagttatgtgaataattacaatcaccaatatatgcaacctaaaattacagtctattctaatttaaaatgttggtattatttaagcccttgactaatggaaagtcttcgatataaattctaaaagtaaatttggctctcttgatacaagtcttgctacttaacagtacccagctctctatagaagtactaattatgtttagaggtttttgttggagaaaaacagttaaaaccaaagttggacttaatcttactgtcttaaatcataaaagatttttttttt

SEQ ID NO: 40473 - DNA, 472 bp, Homo sapiens
  misc_feature 7: n = A,T,C or G
ggaagcngctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatcccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctgggaagttgtgctttt

SEQ ID NO: 40474 - DNA, 274 bp, Homo sapiens
cgcaaaaagcaccgggaaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctttccccgctctggatcctgcactctaacactcgactctgctgctcatgggaagaacagaattgctcctgcatgcaactaattcaataaaactgtcttgtgagctgatcgc

SEQ ID NO: 40475 - DNA, 134 bp, Homo sapiens
taggccgggcaaataaaaaagggtttttttttgttttgatacggagtttcgctcttgttgcccaggctggagtgcagtgagccgagatggcaccactgcactccagacgggacaacagagcaagactccatccc

SEQ ID NO: 40476 - DNA, 418 bp, Homo sapiens
  misc_feature 403, 414, 417: n = A,T,C or G
gtgtggctcctgaggagaataacattatcttgcctgataactgtctcaggggaggccatcactgttgactcaggcaacacagagtttatctccttagacaagggtggaaagtctgatggcagcatgagttggagaggatgttgcctctactgggaatgaggaagctgtttgttctggcagaaatggttcgtcgtagtttaaaaactcagtgtccccagcttcatcagaatccttttacatgtccctgttccaagttgcaggatcccattcttttccaatcaatgccctcacttcaacagacacctgcatgcacctttcattgcaggtcagccactcacatgataagagtttgtgtctgcctttccacaatttcagctctttctctacaggagataagactcanggcaatcctanaana

SEQ ID NO: 40477 - DNA, 405 bp, Homo sapiens
gtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaat

SEQ ID NO: 40478 - DNA, 427 bp, Homo sapiens
gtaaccgcaaaactctagtagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatgtggatttccacctaccgcttacctgaaatgcaggatcacctacttactgtattctacattattatatgacatagtataatgagacaatatcaaaagtagacatgtaatgacaatacatactaacattcttgtaggagtggttagagaagctgatgcctcatttctacattctgtcattagctattatcatctaacgtttcagtgtatccttacagaaataaagcagcatatgagc

SEQ ID NO: 40479 - DNA, 192 bp, Homo sapiens
aaatgggtaaattaaaaatagattgagatccagcaatcccactactagatatatacccaaagggtatgaaatgagtatgtcgaagagatatctgcactcccgtgttcattgcagtattattttgcaatatccaggatatggaatcaagctaaatgttcatcaacagaggagcagataaatataaatgaggtg

SEQ ID NO: 40480 - DNA, 480 bp, Homo sapiens
attcatcatgctagaactcctttaaaaaacagccctgttgtcaacaatggaaaccatgcccttggaattccttgagtctacctatgtgacaccttttataattgttgagattgttagatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttataaataagttcccatgatctgccattattttctttctttacctttaattttaaaaaacgtattccagattgtt

SEQ ID NO: 40481 - DNA, 275 bp, Homo sapiens
catgttttctggttcttctgtagtcttaagtatgtttgatattgttaggtgatctgcataatgtttaatcatttttttctttatataaaccagttggtataattatacctcttttcctatttaagtttgtatgtgtatatgtgattctatagagtagaaaaatgccatcagtttgaaatgatggcacaatcttagttacttggtttaaataaatagaaaattctaaagccttaaaattaagataatgctctttggcaaactcaaaataaaagcga

SEQ ID NO: 40482 - DNA, 342 bp, Homo sapiens
  misc_feature 270, 338: n = A,T,C or G
ggggagagggaggaagggagaaagtgagaagggaaatcggaaagagaaaagggaggaaacggcagagccagagagaaagaggaagagactgagtgtgaaggagagaggacacaggggatgactgagagacagagagagagagagaatgagacagagacttaaggaagagaccctgtgagtctgacaataaaagatttggacagaaacagaaagattggagagagagagagagggagagaatgagtgagagagagactggaagagacaganatcagagggagacacagaaagtgagagtggggagagaggtagtgtaaaaggaagagagagagagaganaccg

SEQ ID NO: 40483 - DNA, 469 bp, Homo sapiens
  misc_feature 393: n = A,T,C or G
cacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaatangttttcccctcttttgttaaataatatggctatgcttaaaaggttgcatactgagccaagtataattttttgtaat

SEQ ID NO: 40484 - DNA, 124 bp, Homo sapiens
ggggctaaatcgcctcctgaggtgactgttgcttattctgctggacaggtttttacataaagcaaagggcatgtgaggggtgggattccttgttactcttactgcaataaaaatcaattgtttg

SEQ ID NO: 40485 - DNA, 342 bp, Homo sapiens
agtctgaagaagtggaacacatgtaggaggatataattaagcatgggaggaaaataacgagtaatatgtgaaatgggaaagcaaaatgaaccgggaataaagttcttttttggtttctagtccaaagttaagcttgaggcatttcttgtttactataaccacaaaatatctaatatctgctagctaataactaatacctgctattttaacagatgttaaaataatacctaataaaaattcacctttgcaaggtgctatggaaagttattctttattgagcgcctttagaaacttgattacaaattagaaacagtcaaattaggaaatacaatccttaaatat

SEQ ID NO: 40486 - DNA, 322 bp, Homo sapiens
  misc_feature 254: n = A,T,C or G
caaggaggtgagggttagtgccaccctgccgatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattngggggactgtgctagctttacccccgcaggacacacacaggagcctttgatctcattaaagagatgtg

SEQ ID NO: 40487 - DNA, 470 bp, Homo sapiens
atcccattactgggtatatatccaaaggaatataaattgttttcccataaagacacctgcacatcacaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaac

SEQ ID NO: 40488 - DNA, 408 bp, Homo sapiens
ggctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggatcttgtactaacttatgatagaatgtatcagaataaatgtttttaac

SEQ ID NO: 40489 - DNA, 401 bp, Homo sapiens
agtttgggctgctataataaaataccacagactgggtggcttaaacaacaaacgtgtatttctcacagtctagaagctgagaattctaagagtgaggcagaagtcactgtctgatgaggacgctcatcctggtttgcagatgctgtaccctcacatagaggagaaagggatctggtctcttcctcttctcatagggcactaaaccaatgattagagcctccaccttctaaacctcatctaaacctaagtactcctccaaggcctcacccccaaataccatcacactggggattagggtttcaacatgaagttcgtggggatacaaacattcagtccacagcactacactttcaagaaagaaaaacagagctttggatgagtggggaccggagaaagagtag

SEQ ID NO: 40490 - DNA, 168 bp, Homo sapiens
  misc_feature 10, 103: n = A,T,C or G
acatttaacnagcttctattatgcctttttctaacacagactttcttcactgtctttcatttaaaaagaaattaatgctcttaagatatatattttacgtagngctgacaggacccactctttcattgaaaggtgatgaaaatcaaataaagaatctcttcacatgag

SEQ ID NO: 40491 - DNA, 473 bp, Homo sapiens
ggatctgaaagcaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtaggagaaaaaaagagccttcttcctgttataataacgatgttgcagctcagccctgaagaaaagggaaaacttgc

SEQ ID NO: 40492 - DNA, 435 bp, Homo sapiens
ctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaac

SEQ ID NO: 40493 - DNA, 353 bp, Homo sapiens
  misc_feature 347: n = A,T,C or G
gggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgngtaaat

SEQ ID NO: 40494 - DNA, 265 bp, Homo sapiens
gttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaagc

SEQ ID NO: 40495 - DNA, 106 bp, Homo sapiens
attgtttacatctgtaactttttcctcccctgttctcattacaccattctggcgaaaatgtaggcaaagtagcttccagttttagaataaataaccatttggattg

SEQ ID NO: 40496 - DNA, 466 bp, Homo sapiens
atagagtaaggcatttattgtaaacctccagggagtttctgaaaatagtatcttctcttcaaacctaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaac

SEQ ID NO: 40497 - DNA, 466 bp, Homo sapiens
ctaaatatatatgcacccaatacagtagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacagcacacctattccaaaattgaccacatactttggaagtaaagctctcctcagcaaatgtaaaagaacagagattataacaaactatctctcagaccacagtgcaatcaaactagaactcagaattaagaatctcactcaaaactgctcagctacatggaaactgaacaacctgctcctgaatgactactggatacataacgaaatg

SEQ ID NO: 40498 - DNA, 127 bp, Homo sapiens
gggtgtgatgtgacaggcctgtagtcccagctacttggatcacttgagctcaggagtttgaggctgcagtgagtcatgattgcaccactgcactccagcctggatgacagcatgagaccccatttcg

SEQ ID NO: 40499 - DNA, 237 bp, Homo sapiens
tgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagattt

SEQ ID NO: 40500 - DNA, 470 bp, Homo sapiens
atatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaagggaagatgagctaggaatcaagaaatacgcagaactgattcctgtcactggcgccaccctgccacttgcccagagctgtggtataaatttttttaataggctgaaataaaaatatgaatagcattttggcgttaagcattaaattgataaaggctatgagatacacctgctctcaaccatgttaattttttattattggtattaataaattattacttactaacatattaacaagaattgcatt

SEQ ID NO: 40501 - DNA, 464 bp, Homo sapiens
  misc_feature 5, 15, 22, 34, 43, 60, 61: n = A,T,C or G
agagnagcactcacncattccngatcttggtttntggacccanctctggaaaagaagccnnatcctagccacttggagctgcctagggaagaccccagcccggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgt

SEQ ID NO: 40502 - DNA, 470 bp, Homo sapiens
  misc_feature 444, 446: n = A,T,C or G
ctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatgggaagagaactttgccgttgaagctgctaactaccaagacactattggccgcctgcaggatgagattcagatatgaaangnggggaatgggctcgtcaccttcgt

SEQ ID NO: 40503 - DNA, 466 bp, Homo sapiens
ggatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagatacctttgtgggttttgtactataatgccaacagggcatttcagaagatggacacaaagaagaaggaggaacagttgaagcctctcaaggagaaatatggcatcaacacagatcca

SEQ ID NO: 40504 - DNA, 441 bp, Homo sapiens
ggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacac

SEQ ID NO: 40505 - DNA, 439 bp, Homo sapiens
ggggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgctgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgc

SEQ ID NO: 40506 - DNA, 299 bp, Homo sapiens
  misc_feature 13: n = A,T,C or G
atttggcaaaatnatatcaaactttctaaagtgtgtatggaaatgtaaaggacagctaatgtcttcagatggatttatattacaaaatataagacctattatagaactgtagcatttaagatagtgtagtattggtgagaggttagatagcagtaaatcaatggaacagaatagagattccagaagcagacccatgcttactggtcatcttatttatgacaaagatgacactgtggtgcagtgggaaaataattttttcccccagcaagaactgcaaggtcaattggatagccttatga

SEQ ID NO: 40507 - DNA, 155 bp, Homo sapiens
ctggataagtaactgttgaaaatttcatgaatatctttcacttattttttgtgcatatgagtgtataatatacaaaaatggtatcatattgacatactgctttaaaacctgctgcctttcagcctgggctgcatagcaagaccttgtctcactta

SEQ ID NO: 40508 - DNA, 473 bp, Homo sapiens
attgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggtta

SEQ ID NO: 40509 - DNA, 393 bp, Homo sapiens
  misc_feature 348, 375, 381, 385: n = A,T,C or G
attgattttttttgtagtatttgtaagagctcagaacttttctgacacactaatgtgcattaagtagttttcgcctccctgtaaactagtcatctgtgcaggctctttgcagccttgtgggtgggattgatcagccctgttgacctgaaggatgggctgttctgtcttttgatttgtttggaagaggagttatgaaaggaagcaagttgaattaatctcattttcactcacttatgtttgatgaaaacagacagtgacagtctccttagttatttcctttgtgcttatgttacagttacttgtgtatttatctcaattttttttttttacttattaaccctggaacanagcttccctaccaatgctacatgccanattganatanaaatatgc

SEQ ID NO: 40510 - DNA, 230 bp, Homo sapiens
caaaaattttaactttcacaaatgacttaatcttttgagaacccattcctctatctataaaaccaccaacttcatagggttgttgtgggtgaagattaaatgagaaatgcatggaaattttctctagacattgatgcattggagtgtgcttcccttcaagtgtcttcctactttcttgctgatgactctaggggtcctgtaagttgggtctcttagagtctcttaatttt

SEQ ID NO: 40511 - DNA, 351 bp, Homo sapiens
  misc_feature 221, 252: n = A,T,C or G
gcttctggaggcaaggatggccggccatgttatgggatctcaacgaaggcgaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcngaaccaccccagtgcacctccctggcctggnctgctgatggccagactctgtttgctggctacacggacaacctggtgcgagtgtggcaggtgaccattggcacacgctagaagtttatggcagagcttt

SEQ ID NO: 40512 - DNA, 237 bp, Homo sapiens
catcctgggtacattgaaatagatgaaaaacatggaaaccaaagcaggaaaaagattaagagataagcattacaaagaaggaataggaaaaagaacagaacattggatgattccattcatttgggtcgtcataacccagtcaactcttgtgttcaccttagttttttattatttcagatgacagatgagtttaagtctttctttataaagataatatatggcattttaggaaatttg

SEQ ID NO: 40513 - DNA, 106 bp, Homo sapiens
gggaggctgaggaaggagactcgcatgaacccaggaggcggaggttgtagtgagctgagatctcgccattgcactcgagcctggacgacaagactgaaactccatc

SEQ ID NO: 40514 - DNA, 443 bp, Homo sapiens
  misc_feature 408, 426, 433, 442: n = A,T,C or G
gtttgtattgttctgagtattccattttttaataggaaattatggaagtggaaattacaatgattttggaaattataacccgcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggtaagtagcctttgagttttacaattattattatcttgggagacatagctgcaggagtaaaagctttttaggatcatgttatctttccttaaaatctggttagatggataatttcataacctattttttttttactctttacttctgtggaaacaggcttcactgtntaaataggagaggatganagcccanaggtaacana

SEQ ID NO: 40515 - DNA, 397 bp, Homo sapiens
gtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaatt

SEQ ID NO: 40516 - DNA, 341 bp, Homo sapiens
  misc_feature 1, 175, 217: n = A,T,C or G
ngcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatactgngcctattgccatactagtctttgccgcctgcgaagcagcggngggcctagccctactagtctcaatctccaacacatatggcctagactacgtacataacctaaacctactccaatgctaaaactaatcggcccaacaattatattactaccactgacatgacttt

SEQ ID NO: 40517 - DNA, 435 bp, Homo sapiens
  misc_feature 174: n = A,T,C or G
gtatggagaaatgacacaggttaggagacgtcgctttgaacgcgctataggaccttctcaaacacacaccatcagaattcaatattcacctgccagactggcttatcaagacaaaggtgtccttcataatgaagttaaagtgagtatactgtggagaggacttccaaatgtggntacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaagaatattgacatgagc

SEQ ID NO: 40518 - DNA, 451 bp, Homo sapiens
  misc_feature 99, 200, 234, 346: n = A,T,C or G
ggtttttagctacttcaagggtacctgaagcgaattggcaccaaagcagcagctgtattgccgcagttctagcttcaccttcacgatgtttcccttggncaaaagcgcactaaatcgtctccaagttcgaagcattcagcaaacaatggcaaggcagagccaccagaaacgtacacctgattttcatgacaaatacggtnatgctgtattagcctagtggagccactttctgtnttgttacatggacatatgtagcaacacaagtcggaatagaatggaacctgtcccctgttggcagagttaccccaaaggaatggaggaatcagtaatcatcccagctggtgtnataatgaattgtttaaaaaacagctcataattgatgccaaattaaagcactgtgtacccattaagatatggcatttttgaagaaataaagtacatttgaaacctt

SEQ ID NO: 40519 - DNA, 175 bp, Homo sapiens
  misc_feature 2, 11, 19, 21, 30, 50, 57, 121: n = A,T,C or G
cnactcttaancggtggangnacttcggcntcgtgcgtcgatgaaagacncgcagcnagctgcgaagaattaatgtgaattgcaggacacacttgatcactcgacactttcgaacgcactntgcggccccgggttcctcccggggctacgcctgtctgagcgtcgcttacaaaag

SEQ ID NO: 40520 - DNA, 214 bp, Homo sapiens
  misc_feature 1, 11, 13, 48, 109, 214: n = A,T,C or G
ntggccgggancnttaagtagcagtggcaaatggccctgtgctagganaactgttcccctgcacaaactgaaaacttgcctcgcttagttcttttccagtgtttttacnactactgcaaaagagtcttccaaaaatactaatctcatatgcatccctaaatgtctagccacaaataattagtagtaccttttaaataatcaatttgtactcgcn

SEQ ID NO: 40521 - DNA, 268 bp, Homo sapiens
  misc_feature 37: n = A,T,C or G
gtgtaagggtccagctgatcagactggcaagaaaatncagccttcgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcc

SEQ ID NO: 40522 - DNA, 152 bp, Homo sapiens
  misc_feature 92: n = A,T,C or G
aaccccggcctgaagaaataaagtaaaattaatctggtaatttgtcacggattagttgtacaactagttagaagtttcagaataaacatgcntttcataactgtcaaatgttcttttaattctgagtccaaataaattatttggtgatgttg

SEQ ID NO: 40523 - DNA, 471 bp, Homo sapiens
  misc_feature 20: n = A,T,C or G
ctgacagcactggacaggtnatcaagacagaaagtcaacaaagaaacagtggatttaaactataccttggaacaaatggagttaaaagatatatacagaatattccatccaacaaccacagaatatacgttctgttcaacagcacatgaactttctgtaagatagaccatatgatagccaacaaaatgagcctcaataaattttaagaaaattaaaattatatcaagcactttctcagaccacagtggaataaaactggaaatcaactccaaaaggaaccttcaaaaccatgcagatacatggaataacctgctcctggatgatctttgggtcaaagatgaaatcaagatggaaatgtaaaaattcctcaaactgaatgacaatagtgacacaacctatcaacctctgggatacagcaaaggtggtgctaagagggaaagttcatagccctaaatgcctacatcaaaaagt

SEQ ID NO: 40524 - DNA, 180 bp, Homo sapiens
  misc_feature 40, 152: n = A,T,C or G
aactttaaaggtggaatatgtaaatagttagggagatccntgtaaaataatgtcttggaaactcaaaagagtccagaaaataccaaataatgagttaaaccttttctgtcttctttccaggatctagtgaaaagccatttgatgtatgcggncagagaagaagtggaggtcctcaaagag

SEQ ID NO: 40525 - DNA, 469 bp, Homo sapiens
  misc_feature 65: n = A,T,C or G
ggtaggagcctctctccctactgctgctacacaagaccctgagactgacctgcaggacgaaaccntgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctta

SEQ ID NO: 40526 - DNA, 472 bp, Homo sapiens
  misc_feature 175, 211: n = A,T,C or G
gtttttaattagccggcatggtggtacatgcctgtagtcccagctactcgggaggctgagatgggaggataacttgagcctaggaaattgaggctgcagtgagccgtgattgtgccactacactacagccggggtgacagagtgagacactgtctcaaaaaataataaataggcnaaactttttaaaaattataatactgccagacatggnggcatgcactggtaatctcagttacttgggaggctaagataggaggatcactgtagcccaggagttcaaggccacagttagctatgactgtgcctgtgtatagccactgcactccagcctgggcaacacagagagaccctatccctgaaattaaaaataggccaggtaaggtggctcatacctacaatcccaacattttgggaggcccaggtgggaggactgcgtaaggccaggaattgaagaccagcctgggcaacatag

SEQ ID NO: 40527 - DNA, 201 bp, Homo sapiens
  misc_feature 3: n = A,T,C or G
agnaaaagactggttaatgataacaactgcctcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 40528 - DNA, 465 bp, Homo sapiens
gattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcaagagttggctttcaaagaatgtactcgacaccttgcgatccaaaatacggagctggcatatacttcacca

SEQ ID NO: 40529 - DNA, 413 bp, Homo sapiens
  misc_feature 117, 147, 161, 185, 228, 288, 299, 320, 343, 366, 371, 409,412: n = A,T,C or G
atgattaactctaagtactattaattaatagccttgcgaaatattagcaattttcccattatggactattctctctaaagcaagagagactagcattcccagacatcattctagggnctttaagctcattttgggtctgctaaagtntggggggaaatgtnacgcaaagtgatactgtgtatgtngccattttgctttattcttctgtggaagcaaaattgtggggtnttattatgtgtgtgtgcttttcctagatgtcccagttagctgtgctgagatatacctgtnctatttatggnttaagttttgattcttaggtnttttctccagctctgacattgtnttccaaagacacactaaactgcnttgcncagttcaaaatttgattacttaagggatcaatctaggnggng

SEQ ID NO: 40530 - DNA, 187 bp, Homo sapiens
  misc_feature 4: n = A,T,C or G
ggcnacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 40531 - DNA, 225 bp, Homo sapiens
  misc_feature 40, 45, 93, 173, 201: n = A,T,C or G
taagcaagatgtatctgtactgatgtctcagtgaatcagnctgtntattaagcacttatcagggcttccacacacttatttattttgccctanttaatcctgttgtttgctgccattggcatgaaatggccaactgtggctgttacagttctttcattcaattataacttgtnaaccagtgactcctaatcttttggaagntaagacaccttaccattgcttatt

SEQ ID NO: 40532 - DNA, 164 bp, Homo sapiens
  misc_feature 66: n = A,T,C or G
cctcggcactctctggccgggactcctagtctgttcctcaacaggtgaatggataaactgtggtantactttacttactcagcaaagaaacagaatgaactgttggtacacagtgcaatgtggatgagtttttaaataattattctgagtgaaagaatccaagc

SEQ ID NO: 40533 - DNA, 469 bp, Homo sapiens
  misc_feature 300: n = A,T,C or G
gaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcnaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggggggaaaaaatggggggg

SEQ ID NO: 40534 - DNA, 428 bp, Homo sapiens
  misc_feature 69, 78, 129, 134, 179, 212, 217, 243, 321, 324, 337: n = A,T,C or G
gacctgaagcgaattggcaccaaagcagcagctgtattgccgcagttctagcttcaccttcacgatgtntcccttggncaaaagcgcactaaatcgtctccaagttcgaagcattcagcaaacaatggnaaggnagagccaccagaaacgtacacctgattttcatgacaaatacggtnatgctgtattagctagtggagccactttctgtnttgtnacatggacatatgtagcaacacaagncggaatagaatggaacctgtcccctgttggcagagttaccccaaaggaatggaggaatcagtaatcatcccagctggngtnataatgaattgtntaaaaaacagctcataattgatgccaaattaaagcactgtgtacccattaagatatggcattattgaagaaataaagtacatttgaaaccg

SEQ ID NO: 40535 - DNA, 422 bp, Homo sapiens
  misc_feature 28, 78, 156, 326: n = A,T,C or G
ctgtattccaaatggatacaatccgacntatataaaagaaacagattcttaactattgactcttatttagcaaatgcnacagacaagaatatccaacttgatatttataaaaggtagactttttccaaaagtgtataagctcaaagaaaaaatgcnacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggncaaataataataattttaatgtcaatgattttttttgtctgactcatctgagttatatttagttttcaagtggcaataaatttatctaccttcttt

SEQ ID NO: 40536 - DNA, 470 bp, Homo sapiens
  misc_feature 143, 174, 215, 259, 309, 333, 354, 460, 463: n = A,T,C or G
gaaatgttttgtaaacatttattttttttaaagaaaagatgaaaggcaggcctatttcatcacaagaacacacacatatacacgaatagacatcaaactcaatgctttatttgtaaatttagtgtttttttatttctactgtnaaatgatgtgcaaaaccttttactgggtgcntggaaatcagccaagttttataatccttaaatcttaatgtncctcaaagcttggattaaatacatatggatgttactctcttgcnccaaattatcttgatacattcaaatttgtctggttaaaaaataggtggtngatattgaggccaagaatattgcnaaatacatgaagcttcatgcncttaaagaagtatttttagaataagaatttgcatacttacctagtgaaacttttctagaattatttttcactctaagtcatgtatgtttctctttgattatttgcntgntatggtt

SEQ ID NO: 40537 - DNA, 470 bp, Homo sapiens
  misc_feature 178, 292: n = A,T,C or G
ggggcattcctgaagctgacagcattcgggccgagatgtctcgctccgtggccttagctgtgctcgcgctactctctctttctggcctggaggccctccagcgtactccaaagattcaggtttactcacgtcatccagcagagaatggaaagtcaaatttcctgaattgctatgtgtntgggtttcatccatccgacattgaagttgacttactgaagaatggagagagaattgaaaaagtggagcattcagacttgtctttcagcaaggactggtctttctatctcttgtnctacactgaattcacccccactgaaaaagatgagtatgcctgccgtgtgagccatgtgactttgtcacagcccaagatagttaagtgggatcgagacatgtaagcagcatatggaggttttgaagatgccgcatttggattggatgaattccaaattctgcttgcttgctttttaata

SEQ ID NO: 40538 - DNA, 470 bp, Homo sapiens
  misc_feature 113, 118, 198, 247, 397: n = A,T,C or G
agcacatgagagggaggacaaggtgcggctgcacttcaagagaccacgttggacaggtgagatgtccaatatattcttacttaagatctgatttcttctccttctctccagcnagggntgcccagagatataacaattagaattcaatacgctaatacagtgtctcattagccaagccacacaatcgcctctagtggnccatatgcacgacaacccgggatcctagaaattagctcggcttcctgcntccgtccccatctgaatctttactcaactactttttgattgtgaagagccaagctcatttgagcagtaggaatttcatggggctggtgatcccaagactaattcaaaaattaataagtttcccattccttttcttatttatttttttggnagggacacatttcaccacacacgcctgcttctttcttgccagtatttcattcaaaactagtcctcaagttttg

SEQ ID NO: 40539 - DNA, 374 bp, Homo sapiens
  misc_feature 57, 141: n = A,T,C or G
gatgggatgtatttttggcttttttttgttgtcgtttaaagaaagactttaacaggngtcatgaagaacaaactggaatttcattctgaagcttgctttaatgaaatggatgtgcctaaaagctcccctcaaaaaactgcngattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacagaaaatgccgattttatttataaaagtgggtacttaataaatggagtcgttatactatgcat

SEQ ID NO: 40540 - DNA, 204 bp, Homo sapiens
  misc_feature 110, 136, 156: n = A,T,C or G
ggcgacaaacctaccgagcctggtgatagctggttgtccaagatagaatcttagttcaactttaaatttgcccacagaaccctctaaatccccttgtaaatttaactgtnagtccaaagaggaacagctctttggncactaggaaaaaaccttgtngagagagtaaaaaatttaacacccatagtaggcctaaaagcagccacc

SEQ ID NO: 40541 - DNA, 197 bp, Homo sapiens
  misc_feature 112: n = A,T,C or G
acacctgcccctgtatatccttttttcccctcccctccctcccagtggtacttctactaaattgttgtcttgttttttattttttaaataaactgacaaatgacaaaatggngagcttatgatgtttacataaaagttctataagctgtgtatacagttttttatgtaaaatattaaaagactatgatgatgacatt

SEQ ID NO: 40542 - DNA, 469 bp, Homo sapiens
  misc_feature 15, 16, 53, 452: n = A,T,C or G
tggatcgggggaagnncgggaaggaagccctgctgctcgttggactatggtcntttcttgtggtgggcattggcattgttccttgtggtggggtgttggcagggagctgcttcccctcagtgggtgctggtctttggtcttgctactcaattggatccagatatgggtgccaggaaggcccatggctgaagcctgacaccggctgctctgaagtctgcccattcatgaactggggcagctgccagttctgggcactgcggaaagtggcttgggactggggcttggtgatgcacgcggcttctgctgcccacagtttcgtgcttacagcctggctgcctccttggctggcccagaaggggtatgccagcaaagcgtacatctcctgttcccctcctggctcaccccttgccatgggactgtcacgccctgtgtggttggaagtgctattactnttgtccgtgtggtggac

SEQ ID NO: 40543 - DNA, 393 bp, Homo sapiens
tattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgttgggttgttgatcttttttttccttacagacacccataataaaatatcatattac

SEQ ID NO: 40544 - DNA, 468 bp, Homo sapiens
  misc_feature 67, 111, 182, 328, 339: n = A,T,C or G
gttgatgtcaagactaccgatggttacttgcttcgtctgttctgtgttggttttactaaaaaacgcnacaatcagatacggaagacctcttatgctcagcaccaacaggtncgccaaatccggaagaagatgatggaaatcatgacccgagaggtgcagacaaatgacttgaaagaagtggncaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatgggngaaggcagtanttctggaaaagccactggggacgagacaggtgctaaagttgaacgagctgatggatatgaaccaccagtccaagaatctgtttaaagttcagacttcaaatagtggcaaataaaaagtgctatttgaga

SEQ ID NO: 40545 - DNA, 368 bp, Homo sapiens
  misc_feature 105, 115, 133, 134, 174, 208: n = A,T,C or G
gtagttggagctcttgcagcttctgcccctatctggcagtttgaggatttagtaccttgtggtgtatttatgaagatcgtaactacagattttaggaaaagcggnccacattgtncagagagcatccacaggnnctgggatgccattaatcgactctcaaatactggcagtggnttgcagtggcttactggagcccttcacttatgcngcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgt

SEQ ID NO: 40546 - DNA, 443 bp, Homo sapiens
  misc_feature 107, 236, 247, 278, 356, 374, 430, 433: n = A,T,C or G
gaggtaggagttcgagaccacctgaccacatggtgaaaccttgtctctactaaaaattcaaaattagccgggcatggtggcgcatgcctgtaatcccaaatacttangaggctgaggcaggagaatcgcctgaaccctggaggcggaggttgcagtgagccgagattgtgccattgcactccagcctgggcaacgagcacaaaactcttggctcaaaaaaaaaatagaggaagctntgaaaagagtncaagaagcacactgcctaatttcggctgctntagaaccagagaaagaaaaaagaaggcgttcaagatcacattctaggaggaggaggactctcatcttctaaacacagncaaggagcagatcaaganagtgattacattgtcagtctaggagtcgtttgatgattcaaaagcccaagacaganaanatctcattcc

SEQ ID NO: 40547 - DNA, 213 bp, Homo sapiens
  misc_feature 72, 142, 159: n = A,T,C or G
gttttcctatatttttatgactgctgagaccccacagggaccaatatttgtattcaaattacatttcatggnttcccattgtttcacaatgagttctaataaatgggatttactataataatccaagtatgacatagccggnatgctttcatgaatgtntttatgtagattttcctcccatgaacatgagtaaataaatctgtttcctgaatg

SEQ ID NO: 40548 - DNA, 235 bp, Homo sapiens
  misc_feature 67, 90, 133, 159: n = A,T,C or G
gtagctgggattacaggtgcctgccaccacgcccagctaatttttgtatttttagtagagacagggnttcaccatgttggccaggctggncttgaactgctgacctcaggtgatccccaccacccaccttggnctcccaaagtgctgggatcataggcntgagccaccatacccagtccaaatggacaaattaatatgagataagcagcctgggcgacggagtgcgactccatct

SEQ ID NO: 40549 - DNA, 473 bp, Homo sapiens
  misc_feature 342: n = A,T,C or G
atggcaagcttctctgatgtgttccctcattctcatgtagtaaataatttgggtgttagcagctttataagaacctttataaacagccattgtgttttcctctcacatgagtctgctccaacatgctggataagcagtggtaattgataaagtcatgtatacagcctttatttccatgggtaaatttatggtcaggaaaatatctgaattagtcttgtctaagacaattgaaagaaatgtcggcatagttcctgatgatggatttttttcatgtaattcttttgcatttggcgagattctaaattgattttatgaataggacggcagattaacctttctgtnacaggctggaaaaatgatcacttggaaacatggtgccccctaatagcattctttgtagcaatcagagataatctgcttgtgtgcagtcatgttattagctcatttccttaagccggttcctaaacttgtta

SEQ ID NO: 40550 - DNA, 471 bp, Homo sapiens
  misc_feature 36, 186: n = A,T,C or G
gctcttcctcggcgctgcctacggaggtggcagccntctccttctcggcatcatggccgccctcagaccccttgtgaagcccaagatcgtcaaaaagagaaccaagaagttcatccggcaccagtcagaccgatgtgtcaaaattaagcgtaactggcggaaacccagaggcattgacaacagggntcgtagaagattcaagggccagatcttgatgcccaacattggttatggaagcaacaaaaaaataaagcacatgctgcccagtggcttccggaagttcctggtccacaacgtcaaggagcttggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatg

SEQ ID NO: 40551 - DNA, 469 bp, Homo sapiens
gtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactc

SEQ ID NO: 40552 - DNA, 234 bp, Homo sapiens
  misc_feature 227: n = A,T,C or G
aaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgcncagaggg

SEQ ID NO: 40553 - DNA, 196 bp, Homo sapiens
  misc_feature 112, 123, 124, 174: n = A,T,C or G
ggatttttaaataaattttcctcctctttcacagtaatttctgaaggagatgctgccaatcccccccgcgcctgcgaagcgcagcggctctaggtatacacttcacattgtntctttgcaggnngcacagcattttaatctgcgcccgcaatgcacaatgcgcgcatgcttgtntgccagtggaagctccatgaac

SEQ ID NO: 40554 - DNA, 446 bp, Homo sapiens
  misc_feature 158: n = A,T,C or G
gagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggnggcagacatgtctaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaaattagggtcatgtacattttcatattagaccttttttgttaaataaacttttgtaata

SEQ ID NO: 40555 - DNA, 469 bp, Homo sapiens
  misc_feature 417: n = A,T,C or G
gctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcntacaccacatgaaacatcctatcatctggggctcattcatttctctaacagc

SEQ ID NO: 40556 - DNA, 345 bp, Homo sapiens
  misc_feature 334: n = A,T,C or G
caagggaggcagacttacctccctcaaccgccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatactttttttttttttnctttaaagacc

SEQ ID NO: 40557 - DNA, 471 bp, Homo sapiens
  misc_feature 104, 158, 460, 466: n = A,T,C or G
agagacagaaagtagagtggtagttgttggggaaggaagaatagggagttgtttaattggtacagtttcagtttttgcaggatgaaaatatcgtagagattggntgcacaaggatgtaaatgcacttaacactactaagctgtacactttaaaatggnaaagatgctaatttttatgttatatatattttaccacattttttaaacagtaaaaggatggaaatgatatgctacattaacactaatcaagagaaatctgggtggtaataatatcagaataggcttcggaacaagaaatagaaccagggataaagacagactttttatgatgacaaagtgatctactcatgaagaagacataatcctaaatatttatacttctaataatagagctttgaaagtaaggtgaagtaaaactaagagaattgaaaggaggagattgacatattcacaatcatagntggggngggtt

SEQ ID NO: 40558 - DNA, 470 bp, Homo sapiens
  misc_feature 314: n = A,T,C or G
gaattgagtccgagataaacccatatatatatatctcaattgtttttgtataaggttgagaaacccttcaatgggggaagaatagtcttttaaacaagtgatgcaggacaacttccaaaaaaggaagttggaccctttacaccacatacgaaaaaataaaatgaatcagagaactaaatttaagagctcaatatataaaactattggaaaaaaatataggtgtaaattttcatggcttggattaggaaatggcttcttagatataacaacaaaagcataagcaacaacaacaaaaatagataaattggactgcntcaaaattaaaaacttgtgctgcaaaggaaaccatcaagaaagtaaacagacaacctatagaatgggagaaaatgcttaaaaattgtatatcaaaaaggagcttatctctaaaatatgtaaagaatacttacaactcaataataaaaacacaaata

SEQ ID NO: 40559 - DNA, 182 bp, Homo sapiens
agagttagaatcatacagtatgtagccttttcagcttagcttctttcacttagtaatatacatttaagttccttctacgtctttttatggcttgataactcattttattttagcattcagcaatgtttcattttctggatgcactacagtttatttaggacttcttaaaataggtcaaaaac

SEQ ID NO: 40560 - DNA, 368 bp, Homo sapiens
  misc_feature 60, 150, 180, 251, 353: n = A,T,C or G
agttttgcaaaatgttatccttgggagaaactgggcaaaatgtacaagagacacactgcnttattttttataactcgtgaatctgcagctatctcaactttttaagcaccagttgaaaaaaaaattatgagattttttttttaaaagggngtctacagctgcaagcagatcgccatcaanaacatatccgagctagagattcattaattcagtctttggcaacacagctagaattggatggctttgagcgnggaccattcagtgaaagacagattaaaaattttcacaaacttgtgagagagagacaagaaggggaagcaaaaactgccaaccaactgatgaatgactttgcngaaaaagagactctg

SEQ ID NO: 40561 - DNA, 305 bp, Homo sapiens
  misc_feature 115, 116, 164, 248: n = A,T,C or G
ggagtgggactctctctaaagaaaaaaacaagtgtatgagatccttgtgtggatgagtaaagagtgaggaaaatgcctagaagcaagttctgaggaactctaaacacttaggggnngggtaatggaggagaagctagacaaggagaacaaagaggaactgtggngggcagatcatctgaagtcgggagttcgagaccagcctgactaatatggagaaaccccgtctctactaaaaatacaaaaattanccgggcgttgtggcgcatgcttgtagtcccagctacttgggaggctgaggcaggaga

SEQ ID NO: 40562 - DNA, 262 bp, Homo sapiens
  misc_feature 55: n = A,T,C or G
ataggaactcttgttgattttaaatatttttcatttctctgtaaatacctgaccntgatctataaaagtccaaaaaatgaggttcatagattttttttgaatagtaatctttatagttcttttctttcatgctttgtgtctttccttcaggtagcaaattatggagttggaggacagtatgaaccccattttgactttgcacgggtaagtgaaaaagaaatggagaaattcactgaggcttatgcattacattgtttgtctc

SEQ ID NO: 40563 - DNA, 418 bp, Homo sapiens
  misc_feature 157: n = A,T,C or G
aggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggntacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaagaatattgacatgagc

SEQ ID NO: 40564 - DNA, 117 bp, Homo sapiens
cgggcgcggtgactcatgcctgtaatccgaacactttgggaggctgaggtgggaggatagcttgagcccaggagtttcacaccagcttgggcaagatagtaagaccctcgtctccat

SEQ ID NO: 40565 - DNA, 470 bp, Homo sapiens
  misc_feature 62, 395, 407, 410, 443, 444: n = A,T,C or G
atcacaaagacaaaaatcatctttatctcatgctcttagtagtctttgagtttactcttggncgtaaggccttaaaaagatttatcaagaaccaacataataagccagccacttatgatgaaactccctttctcctaaaagcagaattagagggagaaatatcaaataaacaaaagaatgcttctcagaccctttctaacctgctaaatctagttatttagattatagagcttgaaataaaaaagagtagaaaattttactccaaaaaaatagagagagtagatttctcagagggcccccatgcccggtaaagatttggtcagttcatcttgatgcagtttacagtttatacagccccaagactgtgcattaccaataatcatcaatattagagncattaagtgtgntgnctttatgtttcctctttgtccctattaatttgnnaacaaagcatctatatccaatagata

SEQ ID NO: 40566 - DNA, 350 bp, Homo sapiens
  misc_feature 70, 109, 113, 114, 117, 150, 234, 310, 324: n = A,T,C or G
ctgcaagacttttagattcttacaatgattactacaggaatagtggccacttaatgtcagttactccggnggaagaatttatctagttttttttcttttcttttttggnaggnnggngtgaaaaatagcaagattagagaatgagttgtntagttttttctatcacatttcatctaaaatgatttgaaggacctttgaagatttttaccaacatccttaaatcaactccaggtnggatgaacaactgatttaaaacaaactaagagaacattaactagatgtgggctttttaaaatatataggtattgcntttcctaccttgtnatttattccactttgaatactttaga

SEQ ID NO: 40567 - DNA, 473 bp, Homo sapiens
  misc_feature 388: n = A,T,C or G
agcttagagcttgttagaaatgcacagtatcaggccccatcggagacccactgagtcagaatctggatgtttacaaatgccaggtgattcatgtgcacaatggatttgaatcccatgcctccaaagcaagtgtagaaaattagtgtccatggcctatttatatgaataacattttactggaatatggtcacacctatttgttttcctattatttacagcaaagttgagtcgttgtgacagcctaaaatatttattaatatttactatatgttcatttatagaaaaagtttgcaatgcttcttaacctggatggctcattagaatcactctggagccttaatactccctctgcctgaatgtaccccacgcccattaaatcagaatgcangtaggggggtgcttgagaccccaggtgtcaacaattctaaaagtttcccaggtgatttaaatgtacagtcaaagtccagaaccag

SEQ ID NO: 40568 - DNA, 369 bp, Homo sapiens
  misc_feature 194: n = A,T,C or G
agtgtagaagtgcttcacgggaggttgttgtggaagcttggaggaataataccttttaaacgtagaagttagtactggaaaggatttcctttgggtctgggaaggtgaggaaagatagtgatacagaattgtgggagaagagcatgctaggcaaaggtaactacctctttctgaaggtggggaatgaaaaggtngcactgtgatttcagaaagctgagttcagtatttaaatgttcagtatttgctttgatgaagtgttaaatacctcctctttcttaccctctccacctagtctatattcatctttaaggagaagtttccagtgacaaggaagtttagatacgtcttttttcttttcttttctttctt

SEQ ID NO: 40569 - DNA, 473 bp, Homo sapiens
  misc_feature 140, 305, 309: n = A,T,C or G
atagtattaatgtatacacattaatgtgtaataatgacatagtgtcttatcttcatacctttacaaccataagataatatgtcagcatttcagaaaggaccatccaaaccttaacgcaaaatatgggcattgcaactggnaatatgctggtaaggaagatgtgtggagaaggagggccttcaggggcctggctaaataatgccctatatgaagctgcctgattttccaaaacaaagaaattcccatcttacccaaattcttggagttgatgttgactgtggaattctaatgtgcttggctcttanggtntgactggtttccctggtgctgctggacggactggtcccccaggaccctctgtaagtaaatcactgtaaacgtgtcttcatttactctagccaaaaggcctggcttctgataggaaactggtaagaaactcttcatgaaaacacatcactaatattcgctattac

SEQ ID NO: 40570 - DNA, 349 bp, Homo sapiens
  misc_feature 28, 68, 105, 114, 128, 138, 149, 196, 213, 279, 319, 332: n = A,T,C or G
aggacagatggatggaatacccatgtcnatgaagaatgaaatgcccatctcccaactactgatgatcntcgccccctccttgggatttgtgctcttcgcattgtntgtggcgtntctcctgagagggnaactcatggnaacctattgtncgcggaaacacacaaggctagactacattggagatagtaaaaatgtnctcaatgacgtgcagcntggaagggaagacgaagacggcctttttaccctctaacaacgcagtagcatgttagattggagggntggggggcatgacactccagtgtcaaaataagtcttagtnagatttccttgtntcataaaaaagactcac

SEQ ID NO: 40571 - DNA, 426 bp, Homo sapiens
  misc_feature 143: n = A,T,C or G
gagtggagtgaggggtaacaagtatggcgaccgagacggtggagctccataagctaaagcttgccgaactaaagcaagaatgtcttgctcgtggtttggagaccaagggaataaagcaagatcttatccacagactccaggcntatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaaagaaagctgctcgggcagctaggtttggggatttcttcagttccaac

SEQ ID NO: 40572 - DNA, 293 bp, Homo sapiens
  misc_feature 108, 158, 159, 168, 209: n = A,T,C or G
gacaatcgagtagtactcccgattgaagcccccattcgtataataattacatcacaagacgtcttgcactcatgagctgtccccacattaggcttaaaaacaaatgcnattcccggacgtctaaaccgaaccactttcaccgctacacgaccgggggnntactacggncaatgctctgaaatctgtggagcaaaccacagtttcatgcncatcgtcctagaattaattcccctaaaaatctttgaaatagggcccgtatttaccctatagcaccccctctaccccctctagag

SEQ ID NO: 40573 - DNA, 162 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgat

SEQ ID NO: 40574 - DNA, 126 bp, Homo sapiens
  misc_feature 10, 63: n = A,T,C or G
aggaaacttntaccatggatactgggggtgggggggaagaagtcccttatatacccttaaggnagggactttgattcttttttctttaaatctccttttgtatcggcattttgttttagtaggtgc

SEQ ID NO: 40575 - DNA, 248 bp, Homo sapiens
  misc_feature 119, 120, 211: n = A,T,C or G
aaggaagaactgcctggagattggttttctgtgtatgctaaagcaagatccaaaatatccatttcgcagagacatgaccagaaagtcccagcacacttgggaacagcattttaagaggnnttgaattattgtgctcattaatatattttcccttctttgatccttttcttgaggataactagagctgctttgctctacaatatttcaagcntggggagaatttagcactaggagaaaccacgtagtcc

SEQ ID NO: 40576 - DNA, 379 bp, Homo sapiens
  misc_feature 1, 26, 116, 136, 153, 191, 225: n = A,T,C or G
ntggccgggcagtatttaaaaagacnaagtattttgtccctttgagattctgcactccctgaaaagttcacttggacgctggggccaaaagctgttgattttcttaagttgacggntgtcaatatatcgaactgtncccaagttagtcaagtntgtctcaacactagcatgatataaaaagggacactgcngctgaatgaaaaaggaatcaaaatccactttgtncataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 40577 - DNA, 212 bp, Homo sapiens
  misc_feature 2, 31, 117: n = A,T,C or G
tnttggccgggattaaattgaaaccttaganaagaccgacgactgtctgtagaaatctgggactgggatcgaacaacaaggaatgacttcatgggatccctttcctttggagtttcngagctgatgaagatgccggccagtggatggtacaagttacttaaccaagaagaaggtgagtactacaacgtacccattccggaaggggactagga

SEQ ID NO: 40578 - DNA, 389 bp, Homo sapiens
  misc_feature 274: n = A,T,C or G
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtngaggcgacaaacctaccgagcctggtgatagctggttgtccaagatagaatcttagttcaactttaaatttgcccacagaaccctctaaatccccttgtaaatttaactgttagt

SEQ ID NO: 40579 - DNA, 180 bp, Homo sapiens
  misc_feature 30, 75, 96: n = A,T,C or G
ttgtacacttaacacttttgttaaaagggnagatctcatgttaaatgtctccaccccaatacaaaaaaaattgcnctattgttttatactactgtnttggaagcagaacatacttcaaaaatcttcagctcagctgggttcagtggcatacacctgtaatcccagcattttgagaggctg

SEQ ID NO: 40580 - DNA, 320 bp, Homo sapiens
  misc_feature 6, 29, 44, 117, 157: n = A,T,C or G
gggggncccactggaggaagcgaaactcntaactttcccaagangctcccgtgaattgctggcagaacctggggccagagcccaggccccactctcaggccagcgctgcttcctggntcctaccccgcctccagtgataaggaagggggtgccctanagcaccccccacaccgccgaaaatacacactctgtttcttacctgccacaactcttcggatctcactcacaaaagtctggaggtaatatgggacacctgggctgtaatgggacgagagcccatgacctccgaaatccatggcaacgtaataaaagtctgaaac

SEQ ID NO: 40581 - DNA, 245 bp, Homo sapiens
  misc_feature 2, 20, 60, 164, 178: n = A,T,C or G
cnccccgggaacctcggccnctctggccggggaggccgtgaggcagccagcgcaggggcntctgctgagggggcaggcggagcttgaggaaaccgcagataagtttttttctctttgaaagatagagattaatacaactacttaaaaaatatagtcaataggtnactaagatattgcntagcgttaagtttttaacgtaattttaatagcttaagattttaagagaaaatatgaagacttagaag

SEQ ID NO: 40582 - DNA, 426 bp, Homo sapiens
  misc_feature 147, 148: n = A,T,C or G
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggnngggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaacaaaaaaatgaaacttttttgagtaataaaaatgaaaaga

SEQ ID NO: 40583 - DNA, 198 bp, Homo sapiens
  misc_feature 8, 27: n = A,T,C or G
agcctagnctgggacgcttgaaaagantgataaaatgaagccttgccaccaattgcccttgtggcaaatggaaacggataaaaataggctcactttaaggagaattacttggggcccagctgaaagtgaacaccctaatgtgtaagaatgtcatcttgttttatttgtattctcctgttttgttgaaggttgtttctt

SEQ ID NO: 40584 - DNA, 247 bp, Homo sapiens
  misc_feature 19, 24, 40, 243: n = A,T,C or G
cggaactgaagccctgatnaaganggacggccgggggcanttcgtattgcgccgctagaggtgaaattcttggaccggcgcaagacggaccagagcgaaagcatttgccaagaatgttttcattaatcaagaacgaaaatgggaggaagcaaaagactctgtacctattttgtatgtgtataataatttgagatgtttttaattattttgattgctggaataaagcatgtggaaatgacccanacct

SEQ ID NO: 40585 - DNA, 500 bp, Homo sapiens
  misc_feature 13, 23, 32, 41, 66, 75, 86, 107, 153, 204: n = A,T,C or G
acccccgggaccncggcccctcnggccggggngtgtttaantggaaactggacggaaccacctcantgcaaagantctacaggaanatgtgggccccctccacctcntgacaactggggacacttacttccttcccgttgtcagtatactgcnccagcttcatcagttgagtaccaatgccagaacttgtattaacttgagggnaacaagcgaataacatgtagaaatggacaatggtcagaaccaccaaaatgcttacatccgtgtgtaatatcccgagaaattatggaaaattataacatagtattaaaggtggacagccaaacagaagctttattcgagaacaggtgaatcagttgaattttgtgtgtaaacggggatatcgtctttcatcacgttctcacacattgcgaacaacatgttgggatgggaaactgggagtatccaacttgtgcaaaaagatagaatcaatcataaagtgcacacctttattcagaact

SEQ ID NO: 40586 - DNA, 258 bp, Homo sapiens
  misc_feature 1, 22, 62, 71, 102, 166: n = A,T,C or G
nccccccgggaacctcggcccnctctggccggggaggccgtgaggcagccagcgcaggggcntctgctganggggcaggcggagcttgaggaaaccgcaganaagtttttttctctttgaaagatagagattaatacaactacttaaaaaatatagtcaataggtnactaagatattgcttagcgttaagtttttaacgtaattttaatagcttaagattttaagagaaaatatgaagacttagaagagtagcatgag

SEQ ID NO: 40587 - DNA, 133 bp, Homo sapiens
  misc_feature 17, 32, 42, 48, 130: n = A,T,C or G
ggccgggcaaccctggnaggcgcggtggcctnctgcctgtantcccancactttgggaagcccaaggcgggcggatcactttgaggtcaggagttcaagaccagcttggccaacatgatgaaaccctgtntct

SEQ ID NO: 40588 - DNA, 258 bp, Homo sapiens
gggggaaagatgagtttaatttggggatattttgaatttgaggtgcctgtgggatgtctatttggagctagcctgtagacattggattaggggagagatgcacatgctacagatactgatagggtaacagttagcagtaatggtaagtgcagccattgcaatggttgtctgtaatgtgagaagacaagatgaagaatagaaccctgcagatcacccatgtttaagagacagggcaggttagaagaaaggggaccttgc

SEQ ID NO: 40589 - DNA, 472 bp, Homo sapiens
  misc_feature 105, 362, 471: n = A,T,C or G
ggcgtcaaagtatttagctgactcgccacactccacggaagcaatatgaaatgatctgctgcagtgctctgagccctaggattcatctttcttttcaccgtaggnggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgcnccgacgttactcggactaccccgatgcatacaccacatgaaacatcctatcatctgtaggctcattcatttctctaacagcagtaatattaataattttatgaatttgna

SEQ ID NO: 40590 - DNA, 329 bp, Homo sapiens
  misc_feature 156, 263: n = A,T,C or G
gtgtaaccctatatagaaagcattaggccctaactttcttaactgggtcatgtttcttgttaatttaccaattgtatccagattctcaactggagctaggatatacttagggcctaagttttctaactgtggacctgagctgggacccacagtgtnctctgttccattttcatcttcatgattttgtggaaagaaacctttataagtcagtaacctaaaagccccaagttagccaccctgctacctgagaggctgaggcaggnaggattgcttaagccaaagagtttgagcccagcctaggcaatatagtgagaccacatctcttattt

SEQ ID NO: 40591 - DNA, 113 bp, Homo sapiens
  misc_feature 63, 107: n = A,T,C or G
aaatgtgattgcagcttttcaatgttagccacagtgtattttttcacttgtactaaaattgtntcaaatgtgacattatatgcactagcaataaaatgctaattgtntcatgg

SEQ ID NO: 40592 - DNA, 368 bp, Homo sapiens
  misc_feature 2, 7, 51, 55, 61, 69, 74, 157, 188, 215, 311, 367: n = A,T,C or G
cnccccnggaacctcggccctctggccgggcgaggagtacccctttctgcntttntttgtntacttctntttanaaatctgtttggtggccaggcgcagtggctcacgcctgtaatcccagcactttggggggccgaggcgggcagatcatgaggtnaggagatcgagaccatcctggcagacgtggngaaaccctgtctctactaaagatacanaaattggctgggcatggtggcaggcgtctgtgatccaagctacttgggaggctgaggcgggagaatcgcttgaacccgggaggcgggaggttgcantgagccgagatcatgccactgcactccaacctggcaacagagcgagactgtctcana

SEQ ID NO: 40593 - DNA, 249 bp, Homo sapiens
  misc_feature 2, 40, 126: n = A,T,C or G
cncccccgggaacctcggcccctctggccgggggagaacngtgggcttcaccaaggacgtgggcaacactcaagtttctggtctgcgcagactgtgaaattggaccaattggctggcattgcctanatgacaagaacagtttctatgtggccttggaacgagtttcccatgagtaactgaggggaggggtactcagctccatctccaaagataaacctactccccacaagaactggcctttaatgtggt

SEQ ID NO: 40594 - DNA, 471 bp, Homo sapiens
  misc_feature 214: n = A,T,C or G
agagactgttggcccgggccgagaaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcnttatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatg

SEQ ID NO: 40595 - DNA, 419 bp, Homo sapiens
  misc_feature 6, 18, 71, 129, 175, 282, 326, 409, 413: n = A,T,C or G
gagacntttttcattacnttacaaatattgatatgctggagggatttgcctacttgagaactcaggaaggngggaaaattcatctggaattactacccaatcaaggaatgctgatcaagtaagcatgtnctcttttgctcttccatgctgagtgctcaccttttgtgtctttgtntgaagtatttgtaaatgtctatacctatcaaaaatttaatacaaaggactttaaacctggtctctgttatgatagtttgattctgggtaccttttgaaaaacttgcntttccttaactacatttcttaaaacactttgcttaaattggggngttttttttgtgcacatttgcaactttttcactagacaaaagtctcattcatgatatcttttactttcaaaaattataggggngagnctatta

SEQ ID NO: 40596 - DNA, 498 bp, Homo sapiens
  misc_feature 8, 17, 40, 100, 135, 141, 158, 172, 215, 399, 437: n = A,T,C or G
ccgggacnctcggcctntacggccgggcaaattcaggaantacagagaacaccacaaagatactccttgagaagagcaactccaagacacactaattgtnagattcaccaaagttgaaatgaaggaaaaaatgtnaagggnagccagagaagtcgggntacccaaaaagggnagcccatcagactaacagctgatctctcggcagaaactctgcnagccataagaaagtgtggtccaatattcaactttcttaaagaaaataattttcaatccagaatttcatatccaaccaaactaagcttcataagtgaaggagaaataaaatcctttacagacaagcaaatgctgagagattttgtcaccaccaggtctgccttataagagcccctgaaagaggcnctaaaaatggaaagcaacaactggtaccagccactgcnaaaacatgccaaattgtaaggaccactgatgctaggaagaaactgcgtcaactaacaagca

SEQ ID NO: 40597 - DNA, 265 bp, Homo sapiens
  misc_feature 1, 15, 58, 137: n = A,T,C or G
nccccccgggaaccncggcccctctggcccgggccttggctgacgtgtcctaaggttnttagcctgttcctccctttcttcaccctccccttttttcttctattaatcaagagaaacttcaaagttaatgggatggncggatctcacaggctgagaactcgttcacctccaagcatttcatgaaaaagctgcttcttattaatcatacaaactctcaccatgatgtgaagagtttcacaaatccttcaaaataaaaagtgatgac

SEQ ID NO: 40598 - DNA, 472 bp, Homo sapiens
  misc_feature 137, 169, 254, 275: n = A,T,C or G
gctttttctttggcaagatggcggagtacgacttgactactcgcatcgcgcactttttggatcggcatctagtctttccgcttcttgaatttctctctgtaaaggagatatataatgaaaaggaattattacaaggnaaattggaccttcttagtgataccaacatggnagactttgctatggatgtatacaaaaacctttattctgatgatattcctcatgctttgagagagaaaagaaccacagtggttgcncaactgaaacagcttcaggcngaaacagaaccaattgtgaagatgtttgaagatccagaaactacaaggcaaatgcagtcaaccagggatggtaggatgcactttgactacctggcggacaagcatggttttaggcaggaatatttagatacactctacagatatgcaaaattccagtacgaatgtgggaattactcaggagcagcagaatatcttta

SEQ ID NO: 40599 - DNA, 365 bp, Homo sapiens
  misc_feature 4, 129, 209, 229, 360: n = A,T,C or G
agantgaggttaacttagagttgggagttgatttattaagtacagtatacctctcaacagtttataaataatatgttgaattatgtcagtgtgggcagcagtagaatactaaaaggaaaatgtcatgtnaagcaatttcagaacattaactgaactattttcaaagcagaaaaattgacattgctgcctttaagaataccatgaatgtnagaaattgaaagaaattgtnaaatatcacataatatagaaatggcagttcaaagagaattgtggcagatgttgtgtgtgaactgtgtgtttctttgccacatgtgttgtatttgaaaagttttacagtaagtttaaaataaaacattctgngacga

SEQ ID NO: 40600 - DNA, 476 bp, Homo sapiens
  misc_feature 4: n = A,T,C or G
gctnttatggaccggggggaacaccacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgt

SEQ ID NO: 40601 - DNA, 374 bp, Homo sapiens
  misc_feature 20, 66, 105, 110, 115, 148, 170, 185, 204, 357, 366, 368: n = A,T,C or G
atccctactaggcttgctcnctttcatccttcactatagatacaacggactttgactaaaagcagngaaggggatttgcttccttgttatgtaaagtttctcggngtgtnctgtnaatgtaagacgatgaacagttgtgtatagtgtnttaccctcttctttttcttggnactcctcaacacgtntggagggatttttcaggtntcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtnccttaagtngngggaga

SEQ ID NO: 40602 - DNA, 469 bp, Homo sapiens
  misc_feature 67, 75, 85, 91, 111, 178, 413, 421, 433, 468: n = A,T,C or G
atagttgactctaacatttcctcatttttctctgaatttgctttttaaaaaactcttccccttgccnttcccttncccattccanattgtnactgcttctttccagctgcntcagaagaaggggactttccatgtaggtgttattctcagaaaaggccagaaaagaccaggtcatggnggggatgatttgctccaagcataaaagagaattgtgatggttcaggaagactggaaaataacgagactggaaagaaatgagaagggcttcagaggaatggcacattgaaataaaaggaagtggtaagaacaggaaaacaagtggaatgaaaggagcacacagtgggcagggatgattggatagactgtggaataaagataatttgggaaaaaaatgggcagaaaataagagaggnttcatggntccattattgtntattctattcctcctactaggttaacatttcccana

SEQ ID NO: 40603 - DNA, 469 bp, Homo sapiens
  misc_feature 54, 61, 75, 79, 189, 230, 253, 271, 284, 418, 428: n = A,T,C or G
ggctgtagtggcttcgtcttcggtttttctcttccttcgctaacgcctcccggntctcgtnagcctcccgccggncgtntccttaacaccgaacaccatgccttcaattaagttgcagagttctgatggagagatctttgaagttgatgtggaaattgccaaacaatctgtgactattaagaccatgtnggaagatttgggaatggatgatgaaggagatgatgacccanttcctctaccaaatgtgaatgcngcaatattaaaaaaggtnattcagtggtgcncccaccacaaggatgaccctcctcctcctgaagatgatgagaacaaagaaaagcgaacagatgatatccctgtttgggaccaagaattcctgaaagttgaccaaggaacactttttgaactcattctggctgcnaactacttanacatcaaaggtttgcttgatgttacatgcaagactgttgcc

SEQ ID NO: 40604 - DNA, 212 bp, Homo sapiens
  misc_feature 182, 195, 209: n = A,T,C or G
actaaagaagtaggtgtttgggcctggcctgatggctcacacctgtgatcccaaagtgctggaattacaggtgtgagccatcgtgccctgccgaaattgaattttctaatgacagaattaaaaacatcagaaggcttagtttaggaaggaaagtgacaggatggattttaggcaggtttggnttgagctgatggncaagaaattgggtntct

SEQ ID NO: 40605 - DNA, 378 bp, Homo sapiens
  misc_feature 105, 151, 169, 272: n = A,T,C or G
tgcggtggcttatgcttgtaatcccatcactttgggaggctgaggcacgtggatcacttgagctcacgagttggagaccagcctgggcaacacagggagactgtntctacaaaacattttttaaataataaaattagccagacaccgtggngtgcgcctgtagtcccanctgcttgggaggctgaggcaggaggatcatttgagcccaggagattgaggctgcagtgagctgtaataaagatactgtggccgggtgctggctcacgcctgcnatcccagcactttgagtggccgaggcaggcggatcacaaggtcaggagttcaagaccagcacggccaagatggtgaaccctgtctctactaaaaatacaaaaatta

SEQ ID NO: 40606 - DNA, 250 bp, Homo sapiens
  misc_feature 93, 113, 117, 151, 201, 209, 210: n = A,T,C or G
aaggtggaacaactgaactcatagataattgattagtgggtcggtgttaatggaatgtggactctgatttttaccctgtttttgagtattggnctgcaacttcagtaaaagcntgcntacaaatctttagatgatacgtgtcttggagggntaatttagatattcaataaaattgtcaggattctgcattcacaaaatgtnaaagtggnntgtaagactacaatagaaactttcttgagaatcgttccct

SEQ ID NO: 40607 - DNA, 298 bp, Homo sapiens
  misc_feature 97, 112, 115, 188, 230, 235, 270, 295: n = A,T,C or G
atattctatttccttttaaatttacctggttcattttctttaccactacagtgctttataatgatataaactacggggaaaggaaagaaagagtggngatagaaacattgtnggncaaaagctgacacataaagactggcagtggagtagagattgggaagagtgttattattttacataacattgtntataagtagtctcacaaaatatttaattttaaaatttttgtnttgtnatttataattcttgtgactttgaaatatcagaatntttatgtttaccttttggggttgtnttg

SEQ ID NO: 40608 - DNA, 470 bp, Homo sapiens
  misc_feature 428, 439: n = A,T,C or G
ggctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttanacatcaaaggnttgcttgatgttacatgcaagactgttgcca

SEQ ID NO: 40609 - DNA, 356 bp, Homo sapiens
  misc_feature 106, 343, 345, 353: n = A,T,C or G
gaagttggggtagcctcggcaggagtcccactcctcctggggtactgcctgccaccaagagctcccccacctgtaccaccatgtgggactccaggcaccatctgtnctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctaaggctggggctacatttggcttctgtactggctgaggananggaagganatg

SEQ ID NO: 40610 - DNA, 117 bp, Homo sapiens
  misc_feature 47, 50, 56, 65, 85: n = A,T,C or G
aactagaagacgttcaagccctggatgacaccgaaaggggttcaggnggntttggntccactggnaagaattaaaatttatgccnagaacagaaaacaagaagtcctacctttttct

SEQ ID NO: 40611 - DNA, 123 bp, Homo sapiens
  misc_feature 84: n = A,T,C or G
caaaagaaatgcttaaagatctcagttggctttatggtgattctagaactgggcaatacttgccaccttaaattagaataaggnttccaatgagttacagcagaggagattggcttcatagac

SEQ ID NO: 40612 - DNA, 146 bp, Homo sapiens
  misc_feature 20, 37: n = A,T,C or G
caccccgggaattcggcacntatggccggctccttcntcctgtaaaggtgaacaataaaaacccaattatggggctgcttttgtcacactagcctagagaatgtgttgaaatttaactttgtaagcttgtatgtggttgttgatct

SEQ ID NO: 40613 - DNA, 482 bp, Homo sapiens
  misc_feature 138, 276, 344, 427, 458: n = A,T,C or G
gatggctagtgtttaatgactacaggtttccaggctccctttaatcttgggagcaaataaatctactattggacttctccctgcgtgacttttaacatttctgatactctctcttcttcctctttacagaagagaggnatgataactgaagttgtactttgcatattgaagtttaaagatacttcctctccccttttcacccctatttcaaatgatgtgataaaatcctcttgataggctatatggagaacatttgtcaatagttttatctatgcntggaagtcttcaaaaagtatatcttggattgtctaaaactgaatagatttcttatttatctgaaggtntacagactgccaacattttagacttatctctcagtctctgccactgaacttttatatatggctgctatcaaaatataaccggnttattttcatatttggaactaatataacagnatcacaaaatcttttacagtaaga

SEQ ID NO: 40614 - DNA, 472 bp, Homo sapiens
aagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggttttgggtttcacatcttcaatgcgaggaatggatgcagtttgaaaatgatcacacttgtaaagtttgggacttatagacttcttgttctgatgtcacgtccttgttcaccaaacag

SEQ ID NO: 40615 - DNA, 299 bp, Homo sapiens
  misc_feature 83, 101, 111, 114, 122, 207, 248, 267, 296: n = A,T,C or G
gaggtccaagtaaaccgctagcttgttgcaccgtggaggccacaggagcagaaacatggaatgccagacgctgggatgctggnacaagttgtgggactgcntgctactgtntanagcttgtntcaatggatctagaacttcatcgccctctgatcgccgatcacctctgagacccaccttgctcataaacaaaatgcccatgttggncctctgccctggacctgtgacattctggactatttctggtntattttgtggccgagtgtnacaaccatataataaatcacctcttccgntgt

SEQ ID NO: 40616 - DNA, 467 bp, Homo sapiens
  misc_feature 101, 106, 196, 328: n = A,T,C or G
gggttcctcttgttttggttattttgtgtagcagtttaatcagtggataactgagcctgtttcctcttagctttctagacttcttaacagaaaaaacagtntgggntcaatagcattttatgattctacaatattttgtcacctagctggaagttgcaataaaaattccttatgaaatatatggttttcatctgtnattgaaggaaatcatagaaagtttgctgaaagcaaagggctaagcttatgaaggaatgcctcctttgttacacactcaagaatttgtcagcacacaattaattgcagccatagtacctttttgcgtaatgtntgggatattcagtagcccaggattgctacaaaaagggcctttgagaaaattaatttgtgcttgcttttatcccctctcagaaagacatcactaaaggccccattaaaaatctggcccctaaaagttcaacttttgtaga

SEQ ID NO: 40617 - DNA, 194 bp, Homo sapiens
  misc_feature 94: n = A,T,C or G
gtctataagaaggagaaagctcgagtcatcactgaggaagagaagaatttcaaagccttcgctagtctccgtatggcccgtgccaacgcccggntcttcggcatacgggcaaaaagagccaaggaagccgcagaacaggatgttgaaaagaaaaaataaagccctcctggggacttggaatcagtcggcgggcg

SEQ ID NO: 40618 - DNA, 387 bp, Homo sapiens
  misc_feature 372: n = A,T,C or G
gctttcccctggctggcagcgcggaagccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagctgaggctccaagagtgtggcccgccgggtcctccaagccctggaggggctgaaaatggnggaaaaggaccaaga

SEQ ID NO: 40619 - DNA, 275 bp, Homo sapiens
  misc_feature 150, 188, 212: n = A,T,C or G
acagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggnttcactgtgaatgcgtgacaataagatattcccttgtncctaaaactttatatcagtttatnggatgtggtttttcacatttaagataattatggctcttttcctaaaaaataaaatatctttct

SEQ ID NO: 40620 - DNA, 472 bp, Homo sapiens
  misc_feature 36, 76, 142, 149, 200, 227, 365, 399: n = A,T,C or G
ctacaaatgcaatgcaattccctcaaaataccaccntcattcttcacagaactagaaaaaacaatcctaaaattcntatggaaccaaaaaaaagcccacatagccaaagcaagactaagcaaaaagaacaaacctggaggcnttaggtnacctgactttatactataaggccaaagtcaccaaaacagcatgatactggnataaaaacagacatatagacaaatgcnacagaatagagaacccagaaataaagccaaatacttacagtgcaactgatctttgacaaagcaaacaaaaacataaagggagggaaaggacaccctattcaacaaatgggggctgggacaattggcaagccacatgtngaaaaatgaaactggatcctcctctcttaccgtntataaaaatcaactcaagatggatcaaagacttaaatctaagacctgaaaccataaaaattctagaagataac

SEQ ID NO: 40621 - DNA, 112 bp, Homo sapiens
atgcaatctgatgagatgagctcagatttaaaaatctcaaaagcacgtttattgtaacaagaattgttatgtattaatactgcagttttcaataaagattgacttgtgttac

SEQ ID NO: 40622 - DNA, 180 bp, Homo sapiens
  misc_feature 40, 56, 82: n = A,T,C or G
cttaaagtgtgcctaaattagaagttataagttatttccntaataaaatctggacntaaatgtctaaataccagtcattgtncataccacgctttttaaattcttattatttccagggcatcaaaatatctgcctttactgggagtactttgtattttctatcagcaaaatcaggatacc

SEQ ID NO: 40623 - DNA, 500 bp, Homo sapiens
  misc_feature 6, 10, 39, 128, 129, 149, 186, 203, 207, 244, 332, 406, 448: n = A,T,C or G
agcttnttanattttcatttatggcaagttataattacntgtaaaagtagtcttgaacaggtaaatattgagcctttttaataggatgtaacctttgtggagcccaaattctaaagaacaagattggnnatccaattaaactacatgcnaaataagtgtgatacatgcatctacaaaaacagtgtnctcattttttctgggtntgcnaatgattggattgtgtctccttgggtctctgtgtgtncaggtaaagaatagtttacagatccctgctgaaattaaaaagaaaaaaatgctcatttggaaagtgcccagtgatgaactggtttgcngaataatctttgaagaagattaatcaggtttttatctttttagaagagatgggtccctggccagaagaaaaggnggggagaaaacatttaaactgtcagttggagcaattcaaggnataatgcttatgtgatggagacctcaattataaattaggtgctagatacaag

SEQ ID NO: 40624 - DNA, 467 bp, Homo sapiens
  misc_feature 201, 411: n = A,T,C or G
attccaaattgacccacagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcttgaatgactactgggtacataacgaaatgaaggcngaaataaaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcnagaaataactaaaatcagagcagaactgaaggaaatagagacacaaaaaacccttc

SEQ ID NO: 40625 - DNA, 399 bp, Homo sapiens
  misc_feature 121, 150, 186, 187, 223, 226: n = A,T,C or G
cagttaagtgcatgcaaaaagccccaaatgaagggattctatccagcaagatcctgtccaagagtagcctgtggaatctgatcagttactttaaaaaatgactccttattttttaaatgtntccacatttttgcttgtggaaagactgtnttcatatgttatactcagataaagattttaaatggnnttacgtataaattaatataaaatgattacctctggngtngacaggtttgaacttgcacttcttaaggaacaaccataatcctctgaatgatgcattaattactgactgtcctagtacattggaagcttttgtttataggaactttgtagggctcatttttggtttcattgaaacagtatctaattataaattagctgtagatattcaggtgc

SEQ ID NO: 40626 - DNA, 310 bp, Homo sapiens
  misc_feature 188: n = A,T,C or G
ggagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggntcagtgactgtggttgctcttcttcaagccagctgatacctgtgcatactgcaggcatctaaattagaagacctgcgagtaaaactgaagaaagaaggatattctaatatttcttatatttg

SEQ ID NO: 40627 - DNA, 210 bp, Homo sapiens
  misc_feature 90, 93, 102, 114, 138, 185, 195: n = A,T,C or G
gtctgatattggatttaagaacagttaaatcttactgcttggaaactgatctttaacaagctagttttcctgctttaaaataatagtgtngtncgtgatgtnaatttccctgtntcacttgacaattacagcaggggnagcttccctgagcacaggatgaggatcagtcagcttgagtatctggnacagaaggcnagctccctgtgcacc

SEQ ID NO: 40628 - DNA, 371 bp, Homo sapiens
  misc_feature 88, 99, 292, 323: n = A,T,C or G
atttgatattctcttatatgttatagtaatgtaacgtataaactcaagcctttttattctttgtgattaaatcctgtgttaaaatgtnacaaaacaggnaccagcattctaattagatttactatatcaagatatggggcaaataggactactagagttcattgaacactaaaactatgaaacaattactttttatattaaaaagaccatgggtttaacttatgaaaatccaaatgcgggatagtaatttttgtgtacttttttaaccaaactgaatttttgaaagactatngcgggtgtgtaaaaagaaagaaaagtgtgtnttatctaatacctgtgagtgagggtgtcatattctggaaaatttaata

SEQ ID NO: 40629 - DNA, 371 bp, Homo sapiens
  misc_feature 16, 103, 137, 172, 188, 273, 292, 314, 349, 369: n = A,T,C or G
attctcagagataccntcagagaacaaacactaatgttaattgcccaattgagtgcttcatgcctttagatgtacaggctgacagagaagattcccgagagtnaatcctctttccaatccagaggaacaagcatgtntctctgccaagatccatctaaactggagtgatgtnagcagacccagcttanagttcttctttctttcttaagccctttgctctgggaggaagttctccagcttcagctcaactcacagcttctccaagcatcaccntgggagtttcctgaggggntttctcataaatgagggctgcncattgcctgttctgcttcgaagtattcaataccgntcagtatttaaatgaagtantt

SEQ ID NO: 40630 - DNA, 156 bp, Homo sapiens
  misc_feature 2, 52: n = A,T,C or G
gnggggaacctggcgctaaaccttcgtagacgacctgcttctgggtcggggnttcgtacgtagcagagcagctccctcgctgcgatctattgaaagtcagccctcgacacaaagggatacaactataaatgtaataaaatttatgtgctagaagtt

SEQ ID NO: 40631 - DNA, 162 bp, Homo sapiens
gtttggccgcttgctttttgggagaagacttaatctgatttatgaaataaccttgggttttttgtttgtcgtcttttatttaatgttggcaactaccatgtaaatctaagtattaggcccctgtgaatataaggcaatttccaatttttccaatcagaagat

SEQ ID NO: 40632 - DNA, 285 bp, Homo sapiens
  misc_feature 12, 184, 207, 249, 261: n = A,T,C or G
attaccgcaagnaataaaaaagaaatcctatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgngctagaatactttttaaaaggtnttttgaataccattaaaactgcttttttttttccagcaagtntccaaccaactnggttctgcttcaataaatctttgc

SEQ ID NO: 40633 - DNA, 304 bp, Homo sapiens
  misc_feature 202: n = A,T,C or G
accctggaattcactctgttgggttttgtttgtttgtttttttggggggaggggtttgtttgtttgtttgtttttgagacagagtcttgctgtgtcgccaggctggagtgcagtggtgccatctcggctcactgcaacctctgcctcctgggttcaagcgattctcatgcctcagcctcccaagtagtgcatgtcctcccancctctcaagaggctgaggtgggaggatcacctggagccaggagtttgaggctgcagtgagctgtgatcctgccactgtactccagcctaggaaactctgtct

SEQ ID NO: 40634 - DNA, 452 bp, Homo sapiens
  misc_feature 140, 384, 392, 403: n = A,T,C or G
caccccttaatctgcatgcaattacaagtgggtataaatatgactggaaacccctgagctgctaccctctgcctaaggggtagtcctgcactgcaggagcagtcatggagctgtaacactgcctcttcaattaagctgtntgcttctacctctggcttgcccttgaattctttcctgggcaaagccaagcaccctcgtgggctaagctccacttttggctcgcctgccccgcatcaagagcacaaccagctctccctggactcttcatctgggaatggacaaggaagacagcattacagtgtgtggagccccccaggccttgatgtgggcatcacgtggctgagatggcttcatctgtgaaaaggagccagaactctttatcangctaggcngggcttttgtntaactggtccctctggctgcttttgttgacagataaaggagtattttac

SEQ ID NO: 40635 - DNA, 278 bp, Homo sapiens
gaacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtg

SEQ ID NO: 40636 - DNA, 303 bp, Homo sapiens
  misc_feature 35: n = A,T,C or G
gagccagactagaggggaaactatcacctaaaatngtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacat

SEQ ID NO: 40637 - DNA, 469 bp, Homo sapiens
  misc_feature 5, 8, 9, 14, 18, 22, 27, 32, 45, 46, 52, 53, 66, 78, 99, 410: n = A,T,C or G
agganccnnccgcntcanaccnactangactntagactcaagcanncttatnnatgcggccgctantaaagctcactnggccacattaagccctatagngagacccacttctaccaaaaagccaaaaacaatgcctagagtgagaaaaccgaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcnttatcatcaatcccatgctttccgatgagaccaatatatgcaatggtaagccagtagat

SEQ ID NO: 40638 - DNA, 303 bp, Homo sapiens
  misc_feature 98, 142, 168, 251: n = A,T,C or G
attattaaataaggaaagcattttgtgatatgtggaagacgctatgtgaagttttacctatcttctcaaagaccttttcttttgtattttcttttggngtttcttaaagccaaacaaagaaatgttcttaaggagacagggngggtttttctgtgggcctttgttggnttttctgtgggccatcgccctctaatggaattgatctctggctgtttgatttttttcatattgtatttttaaaatttgttgtncagtgccctgtgagcaccaagtaccactagatgaataaaacgtattatatct

SEQ ID NO: 40639 - DNA, 417 bp, Homo sapiens
  misc_feature 13, 60: n = A,T,C or G
cagatgccaaagnccccaaatcacacttgagtcgtctcctcaagttagaatgagcaatanaaaaccagacagccctgtatctatgggaatgttgcttgcatcagagccaccacaccttgctgtgaggttgatcggtttctcgcagctggaaatagttgcttcccgccccccatcttcctcactcttttaaactctcaaaaatcccccagcctcccaaatttgttttaatttttaagagaattcttttctacaaaagagggaaaccttctttcaaatggcccttcataaatttccctaaagaggtttttatctctgatagaaatatgaaaaacagataaccagataattgccctctatctaggctttaaacacttattcatacattgaatttctgcaagttacagatgattgttgctg

SEQ ID NO: 40640 - DNA, 263 bp, Homo sapiens
  misc_feature 131, 178, 247: n = A,T,C or G
aaagcctggaatgatatcaaaaaggtctatgcctctcagcgaatgagagctggcaaaggcaaaatgagaaaccgtcgccgtatccagcgcaggggcccgtgcatcatctataatgaggataatggtatcancaaggccttcagaaacatccctggaattactctgcttaatgtaagcnagctgaacattttgaagcttgctcctggtgggcatgtgggacgtttctgcatttggactgaaagtgctntccggaagttatatga

SEQ ID NO: 40641 - DNA, 415 bp, Homo sapiens
gaatcttagttcaactttaaatttgcccacagtaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatactcat

SEQ ID NO: 40642 - DNA, 238 bp, Homo sapiens
cgaactcctgggctcaagcagtcctcccaccttggcctcccatagtgctgggattacaggcatgagccactgtgcctagccagaaattggcttaaaatgcagatttttggaccctgtccccagcaaaaagattcggtagaaatctttattcgtagccagtttactgtgttgcaggtggtccccagtttaactttgagtaatgctgtcttgttgttaaaataatcagatttaattatat

SEQ ID NO: 40643 - DNA, 266 bp, Homo sapiens
agtcctcccacctcagcctcctgagtagctgggattacaggtgtgtgccatcaagcccggctaatttttgtatttttagtagagatggggtttcactatgttggatggctgatctcgatctcctgacctcaggtgatccgcccaccttggcctcccaaagtgctgggattacaggcatgagccactgtgcccggcctgtttccttgaattggatcaaaatatgatctatacattacaatcaggtaatgtttcttacctgatttttg

SEQ ID NO: 40644 - DNA, 281 bp, Homo sapiens
  misc_feature 269: n = A,T,C or G
caccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctnttgctgagaaga

SEQ ID NO: 40645 - DNA, 402 bp, Homo sapiens
  misc_feature 32, 334: n = A,T,C or G
gtctccaaaaaaaagtccacatcttcatgaancctcaaactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaanaaaacatggcattgagtgtgctgagtccagacaaatgttatttatatacacatccaaatttgaagaga

SEQ ID NO: 40646 - DNA, 282 bp, Homo sapiens
  misc_feature 211, 219, 257: n = A,T,C or G
tagtagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctnaccattcncctttctcccttccctcctcttgctcctcaagtaagangtgcagagatgaggtccttctggac

SEQ ID NO: 40647 - DNA, 342 bp, Homo sapiens
  misc_feature 30, 31: n = A,T,C or G
gaatgccaggggacttggatctgagctaanngacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttga

SEQ ID NO: 40648 - DNA, 389 bp, Homo sapiens
  misc_feature 8, 34: n = A,T,C or G
acatagcnaaatgcgaaacaggttggccgccttnaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatac

SEQ ID NO: 40649 - DNA, 128 bp, Homo sapiens
ctttgtttgtttttgtttttggttccgttttttgagagggactctggctctgtcgcccaggctggactgcagtgagccaagatcgcgctgttgcactccagcctgggcaacaagaacgaaactgtctc

SEQ ID NO: 40650 - DNA, 488 bp, Homo sapiens
gatttcctgttagcctatgaaatgttattgttctataaaaataactttaaactgattcaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcat

SEQ ID NO: 40651 - DNA, 423 bp, Homo sapiens
atttcagcaggagctgtgttgttttctctatgcccttttgtttacatgtgaatataatgtaactatatattttttcttttttcttcttcagtcatagtcttctccagcctgggcgacaaagcaagactttgtctcaaaacaaacaaacaaaaaacccacatacacactagaaagatgggtgggattacaggaaggcagatgcagaccctgaagcctgcgatggagctgattttgtatttccagcattaacaagttcctcccatgttcttccatttgctcacagacctcccacagcccagtgtgccaggacgtgctgaaattcatcagtcagtggtgtgggagggctccccagcaccagcttttcctttcagtagtcggtagagctgaggaagagttagggcctctccctcattaaagttttat

SEQ ID NO: 40652 - DNA, 161 bp, Homo sapiens
  misc_feature 10: n = A,T,C or G
gactcttagncggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 40653 - DNA, 398 bp, Homo sapiens
  misc_feature 24, 25: n = A,T,C or G
cgctgctgataaagacatacccgnnactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatgc

SEQ ID NO: 40654 - DNA, 463 bp, Homo sapiens
accgtgaggatggtgtgaccccatatatgattttctttaaggatggtttagaaatggaaaaatgttaacaaatgtggcaattattttggatctatcacctgtcatcataactggcttctgctgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaaga

SEQ ID NO: 40655 - DNA, 322 bp, Homo sapiens
aaggagctgaacttgtcaaggtttagatgtggtaaagcaggccaggcatggtgactcatgcatgtaatcccagcattttgggaggccaaggcaggaggatcacttgagcccaggagtttgaaagcagcccgggcaacatagtgaaaccccatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtct

SEQ ID NO: 40656 - DNA, 204 bp, Homo sapiens
  misc_feature 32: n = A,T,C or G
agtctcctggaagagcagttccagcagggcangcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttccctc

SEQ ID NO: 40657 - DNA, 235 bp, Homo sapiens
  misc_feature 7: n = A,T,C or G
cacaaantatgtgtaagattgttacacagagtaatcataaacattgctgagagaaattaaagaagacctaaatcaatagagggacataccatgtttatagattagagactaaatattgtaaagaggaagattcctcctaaattgatctatatatttaaatctaattctgataaaaatcctgcataaaattttgtggaaattaaaaagttgttttttaaaatgtatatggagatgc

SEQ ID NO: 40658 - DNA, 500 bp, Homo sapiens
  misc_feature 24: n = A,T,C or G
tctttaaaagaggtaagagcaacncgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattct

SEQ ID NO: 40659 - DNA, 490 bp, Homo sapiens
aacaaacggcttgagtatatgaaatggaaaattgaggttctgtgggttggaacagagatcttcagtacaaagttgtgaccttggaatggaaaggactgaaaaaaaatcatcagaacagaagagacaaggaagctgtgtcttagaaaaagaatgtctccttcaaaaacacatctctatggatttgtacctcatttaggtttgggaattgaatttgtactacttgtgtagtatggaaaaatcacaacttgaaaaattaactacagagagcccagattactgatacttctaaagcacctggcagaatctgttacaaacttcttaggagaaagataccattcaaccaagtttcacaagattcctaaacataaatatcttctaaagattaactcacaacctcaaactataaaacataagaacaaaatcccccacaagtgagagttagcaaacacaaagagcaggattagaataagacctaaaagtgatggaacta

SEQ ID NO: 40660 - DNA, 127 bp, Homo sapiens
tagatgaagcaacgcagctagactgcgagaattaatgtgaattgcaggacacattgatcatcgacacttcgaacgcacttgcggccccgggttcctcccggggctacgcctgtctgagcatcgcttg

SEQ ID NO: 40661 - DNA, 432 bp, Homo sapiens
  misc_feature 5, 30: n = A,T,C or G
ggcgncattggagtcaagatggaggagtantcgcgagtaccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctct

SEQ ID NO: 40662 - DNA, 413 bp, Homo sapiens
aggaacatggctgtgctgtgtgtcacagcgcaggacaacaccagatgtttctgttgggttgaatttctattgggttaaatggaattaaattaattgagtcaaactgtgctttgtgcctctgtagaaaaatttaaagagttagaaaatataggaaaatttccatggacaaatgctagaagaaaacagaatactactgcttaaaaggaaaactttaattcctgaaaagatttgtttctgtggaagactgcattcatagacaatacctaatgaagaagtatagctataataaaattattatacaagagttgatgattgaaatttttagtgaaggccaggcacggtggctcacgcctgtaatcccagcactttgggaggctgaggtgggcagatcacctgaggtcaggagttcgaga

SEQ ID NO: 40663 - DNA, 321 bp, Homo sapiens
atggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtac

SEQ ID NO: 40664 - DNA, 305 bp, Homo sapiens
  misc_feature 30: n = A,T,C or G
gggcctatgccatttctgttgtagtttgtngcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgg

SEQ ID NO: 40665 - DNA, 490 bp, Homo sapiens
  misc_feature 32: n = A,T,C or G
gtacccctaaaacataagataaaaaagagtantgaatattgagaatccaatagacagagttgagaaccagttaaacataagaaagaattagtgaattggaagataactgcccagaatgaagcataaagagaccaagaggtagaaaatataaggctagagggtcagagacattgaagctacaatcagaacaactaacatacttctgcagttccagaagattagaagagagaaaatgggccagaagcattgtggagatttttccaaaagtggtaaagtgtatcagttcatatatttttagaaaccatcaaacttcagacaagataactaaaaccaaattaatataaaatgacaggacatcaaagaccaataaaaaacctgaaaggtaactaaaggaaaagacagattatgttaaagggaataactgtctaaatgacaacctgattttcaacagacaaaaatgtagctagaattcaatggaatcatgccttca

SEQ ID NO: 40666 - DNA, 381 bp, Homo sapiens
  misc_feature 2, 19, 36, 45, 340: n = A,T,C or G
tnttatggccgaggatgtnagcactgttgctcaggnagtgacaanttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaagtaaacctggcagctatanaatacactatgtgcatttataatagctattttatatatttg

SEQ ID NO: 40667 - DNA, 126 bp, Homo sapiens
  misc_feature 31: n = A,T,C or G
ggaatgcgagtgcctagtgggccacttttgntaagcagaactggcgctgcgggatgaaccgaacgccgggttaaggcgcccgatgccgacgctcatctcccgcaaataaatgtattggtgatttgg

SEQ ID NO: 40668 - DNA, 151 bp, Homo sapiens
  misc_feature 6: n = A,T,C or G
cagacngtgttcccattgctctccatcctatttttctatctaaatgtgtcatgattttagaatctctttgtaaagaaaaccaaaaagagccatgcccaaaagaatgagcatgaaatgaagcaattcaagtatttagaatttcttcttcttt

SEQ ID NO: 40669 - DNA, 398 bp, Homo sapiens
  misc_feature 11, 33, 220: n = A,T,C or G
aactcaccagnaactgaagaaacagtgcaagcnctgagcttgttttccttcaactagatggtcccacctgggggtgatgtgagacagtaacagatcatcaggcattagattgtcataaagagcatgcaatctagacccctcccatgcacagttcacaatagggttcacactcctatgagaatctaatgccaccactgatctgatgggaggcggagcttangcagtaatgtgagtgatggggagcggctgtaaatacagatgaaggttcatttgctcacccactgctcacctcctgctgtgtagccccattcctaacaggccattgactggtaccagtctgtggcccaggggtttgagggtccctgccctagggcttcaatgcctacagaagcataaga

SEQ ID NO: 40670 - DNA, 433 bp, Homo sapiens
  misc_feature 8, 33, 34, 60: n = A,T,C or G
ggctctcnctcagacataattagattacgaatnnagacattaatagaagatgaaattgcnaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggtaagaaaattatggtttgctgaaaatgttagccttatataagtgttgccgttttgtaatg

SEQ ID NO: 40671 - DNA, 373 bp, Homo sapiens
gtctcctagtgtttccttttgctgtgctgtgtcccgtatatcctgtcatttccatttattttatcctcaaattataaagaattgtagtgttaagtccgttattcactttaagatgcagccagaacagtgactggagtggtttcatacctcatgggtttcccacacttccatcaacacacacttcacaacaccttggaggcattgtgaaaaggtcaagctttggagatggggaagagtcctgaagatgttgggtgacattgtacagtgaatggaggctgcctgcttggcacactttccatcacacatcacattttgctaatcttttggaataagggggaaagacatttaaatgagataattagagataagaatg

SEQ ID NO: 40672 - DNA, 129 bp, Homo sapiens
atggccgggaggaatgcgcttttttttgtacacatttttatccattttacattctaaagcagtgtaagttgtatattactgtttcttatgtacaaggaacaacaataaatcatatggaaatttatattt

SEQ ID NO: 40673 - DNA, 490 bp, Homo sapiens
  misc_feature 30, 33: n = A,T,C or G
ggaaatcaaaaaggggtggggggctgctgnttnttgctggaacacatccgaagggccttagaggggcctttgtgttttataatctgtctcacttgatcagagaaaaatatggaaatttgtgcaatgagaaaatatcctagtgtgaatacagacaggcatttcattgaaactatacaattatttacaactaacttgacaatcccaaatgaaaactgtctactacacaacagaaaaccattaaaacagtgctaacatcaatagagttccttttataaaaagaaaactaaattgaagttaccagcaggttacttttactttccacttggtttttccttttggttatattactgacaggcaccaaagtagctacagagaaacatacatgcagaaatccaattgccaagaaatcttttgcatctgaatcacttgggactctgtgtgcctgatcatactacaaacttctgaagttattctacaagcctcaaaatgc

SEQ ID NO: 40674 - DNA, 417 bp, Homo sapiens
  misc_feature 31, 33: n = A,T,C or G
gaggcactgaggcagccagcgcaggggcttntnctgagggggcaggcggagcttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaggacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttg

SEQ ID NO: 40675 - DNA, 117 bp, Homo sapiens
  misc_feature 25, 113: n = A,T,C or G
tacgcacgcatgtgtcccaaatccngttttaattttttttttctgaatgtgatcatgttttggatgatacctgagcagggttgccttttttttatttattaccattatatatnatat

SEQ ID NO: 40676 - DNA, 127 bp, Homo sapiens
  misc_feature 8: n = A,T,C or G
atctgtcnaagttttgctttgttgatctgagtccttctatgaaagtttaaatatgtaacgcattcatgaatttccagtgttcagtaaatagcagctatgtgtgtgcaaaataaaagaatgatttcag

SEQ ID NO: 40677 - DNA, 485 bp, Homo sapiens
gaaatgcccaatttgggcggctcccccacctttctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgca

SEQ ID NO: 40678 - DNA, 342 bp, Homo sapiens
  misc_feature 7, 14, 33, 34: n = A,T,C or G
gataatnttgaatnaatgaaaagttttgattanncagtagttgtagatatgctaagtttttcaaattactaatatcaagtggagatgtttttacttttaagggtattgcttttgtgatagcataaatagtggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaactttt

SEQ ID NO: 40679 - DNA, 244 bp, Homo sapiens
  misc_feature 31: n = A,T,C or G
ctttgtcgatttttggaatcttatgagtaanagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaagggga

SEQ ID NO: 40680 - DNA, 401 bp, Homo sapiens
  misc_feature 30: n = A,T,C or G
cgtgcccgacctgtcgtctggtccctgttntcaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttct

SEQ ID NO: 40681 - DNA, 323 bp, Homo sapiens
  misc_feature 7, 31: n = A,T,C or G
gtttttnattatcggttttccttggaggggncagttctctatatttcaatctatttctctatatcagaaatgagcaggcattttaaaaaatggttttcattgatggagaggtaaaagtgaaatggctttgttgtatttatattataaaaggccatttcccaaatctagaatttattactaaaaatcaagtttgcattgaggggaggagtatgatttgctcaagcttactttttttataggtggggtttttatattttcaatgtgattactcacccatacaatttcagctctttcaaagcattcttgttggctattttcagagt

SEQ ID NO: 40682 - DNA, 446 bp, Homo sapiens
  misc_feature 23, 35: n = A,T,C or G
atacaccaatggaacagaacagnagccctcagtanataataccacacatccacaaccatctgatctttgacaaatctggcaaaaacaagaaatgggtaaaggattccctatttaataaatggtgctgggaaaactggctagccatatgtagaaagctgaaactggatcccttccttacacaatttttttcttttatatttattgcctgtgtcctaagaaacctttggctactcccatgtcatgatgatattgtcctgtgttttcttctagaagctttatctctttggtttttgtatttagttctattaatctggtcaaattaaaatccatttattgtatgagttgaagccaaatccaatttttacttatggatatctagttattgcagaactatttgctgaaagactcttttctcccattggattgcttgaacaatatatctaaat

SEQ ID NO: 40683 - DNA, 129 bp, Homo sapiens
acaaatactttctaattttctttagactttctctttgacatgtgggctatttagaagtgtattgttcagtttccaagcatgtggaaacatctggagatttgccagatttttctttttctttttttcttt

SEQ ID NO: 40684 - DNA, 224 bp, Homo sapiens
agagaccgagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaat

SEQ ID NO: 40685 - DNA, 489 bp, Homo sapiens
  misc_feature 35: n = A,T,C or G
caagaatccatattttaaaacgtctgtatgagttnaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgt

SEQ ID NO: 40686 - DNA, 410 bp, Homo sapiens
  misc_feature 30, 57: n = A,T,C or G
aacacactccgttgcaaacccaaagacccntttactttccaatctcagtcactctangactctgcactgaatggctgacctgacccgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagga

SEQ ID NO: 40687 - DNA, 213 bp, Homo sapiens
aggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtg

SEQ ID NO: 40688 - DNA, 386 bp, Homo sapiens
  misc_feature 20: n = A,T,C or G
accagactcgtctcaggccncctgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacga

SEQ ID NO: 40689 - DNA, 129 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaata

SEQ ID NO: 40690 - DNA, 107 bp, Homo sapiens
taaaaaagttccataaagcatcgccaaggcagcatgcctgtgcgacacacgcagggctttgggggtgtgttttccccgtattaacagcaagtcgttgaagcgttgag

SEQ ID NO: 40691 - DNA, 270 bp, Homo sapiens
  misc_feature 58: n = A,T,C or G
aacgtcaatttccttatctaaaatagtggtttgtttaaatgatgaagcaaagatggcnttggagctgttggctgactgtccctttttttctgctaactgcagaagcacggaatctgatgccctactttgtggggtaatggtgtgcttatctccccctcctcaaacagagtttggcacgttgctaataacagccagcctactgctaaaatatcaatgacagaacagaagaaatagatatttaggaaaacataaatcaaagctgaggaagta

SEQ ID NO: 40692 - DNA, 353 bp, Homo sapiens
  misc_feature 31: n = A,T,C or G
gggtaccccaaaccaattttaaaggatttgnaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggaga

SEQ ID NO: 40693 - DNA, 265 bp, Homo sapiens
ggttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccac

SEQ ID NO: 40694 - DNA, 405 bp, Homo sapiens
  misc_feature 44: n = A,T,C or G
atggaccgggatacccacctcattgcgaatgacagggcctattnactcaagcaggacttgcagagggacgagcagaaagatgcatctgactttgtggcttccctcctcccatttggaaataaaaggcaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggac

SEQ ID NO: 40695 - DNA, 391 bp, Homo sapiens
ctagcatttctatccgctaaactaagtcttcataagtgaaggagaaataaaatcctttacagacaagtaaatgctgagggattttgtcaccaccaggcctgccttacaagagctcctgaaagaagcactaaatatggaaaggaaaaaccagtatcagccactggaaaaacataccaaattgtaaagaccattgacactatgaagaaactgcatcaactaatgggcagaataaccagctagcatcataatgacaggatcaaatacacacataacaatattaaccttaaatttaaatgggctaaatgtcccaatttgaagacatagattggcaaattggataaacagttaagacccatcagtgtgttgtattcaggagacccatcccacgtgc

SEQ ID NO: 40696 - DNA, 325 bp, Homo sapiens
  misc_feature 7: n = A,T,C or G
gaagggntcagacacttgaaatttgctcagaaatagttgcattacacgcccagtgtgcaatggctgaaattcaggcacattcatgcttactgttctctgagatctgaacaaaatcaaattgcactgagcaaggatagtgctcaatcttttgttctttctgccaactaaaaattaaccagcggttgtttacttccctatataattctgtttaagagaatctggaccattgagacaccaggcttaaaatgttgtattaagatataaaagtaccttactttaaaaatagatttttattgatttatttcaaaattgttctgtcagttat

SEQ ID NO: 40697 - DNA, 334 bp, Homo sapiens
attttaaaaataggaatatgccttattgaaaaggcttcttagcaatgtgtcatgttcacctggaaggtttggtgtctcttagaattgaagggattttagaatcaatgaaatatactatctataccttgcttcatgcttctaacttctgtcaaattttgtggatatttagataattcaagagtaccagggtctacagtgtgtgcagctgtgcgtctttgctaatcaagtacaagaaagtcaaatattttaatgtttatattggaaagcttcatagaaatcaagttcccattgaataaaaggccaaaaaataaacaaaattatacttttaagaaat

SEQ ID NO: 40698 - DNA, 101 bp, Homo sapiens
  misc_feature 19: n = A,T,C or G
cttcccctggatgggaaancatctcaaggcctgaagctgcccagcaggcattccaaggcctgggtcctggtttctccggttacacaccctatgggtggctt

SEQ ID NO: 40699 - DNA, 194 bp, Homo sapiens
  misc_feature 2, 10: n = A,T,C or G
gnacacaggnatccggaagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaaattctttttcgtgaagaactc

SEQ ID NO: 40700 - DNA, 330 bp, Homo sapiens
  misc_feature 5, 9: n = A,T,C or G
cttcncagnactatcctatctaaaatatcatatcctctccccatccatccttggccgggcgcagtggcttatgcctgtaatcccagcactttgggaggccgaggtaggcggatcatctgaggtcaggagttcaagaccagcctggccaacatggtgaaaccccatctctactaaaaatacaaaaattagccaggcatggtgatgcacgactgtagtcccagctactcgggaggctgaagcagaggaattacttgaacctgggcggcagagttgcagtgagctgagatcgcaccactgcactccagcctgggcgaaagagtgagactctgt

SEQ ID NO: 40701 - DNA, 240 bp, Homo sapiens
  misc_feature 63: n = A,T,C or G
gcaggcaggaggagagtagaaaggagagacaattatgttcctgaggtctcagccttggatcangagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagc

SEQ ID NO: 40702 - DNA, 115 bp, Homo sapiens
  misc_feature 7: n = A,T,C or G
ctgctgngcacggtggcacatgcctgtagtcccagtcgctcaggaggctgaggtgggaggattgcttgaacccaggagtttgagcagagcctgagcaacatagcaagaagccatc

SEQ ID NO: 40703 - DNA, 240 bp, Homo sapiens
gaatttgtaatttaaaacttcacccccaagtaaatctttactccagatgatttcagtggagaattctatcaaacgtctaaagaattaacaccgattctacaaatctgatccagaaaatagaagagatgaagcatttcctaagtcattttatgaggcccatcttacccatatcaaaaccagacaaggaaaatacaaaaaagatgactacagaccaatgacctttaataagaacacagacac

SEQ ID NO: 40704 - DNA, 321 bp, Homo sapiens
cacgcccagctaattttgtacttttagtagagatggggtatctccatgttggtcaggctggtctcagactcctgacctcaggtgatcctcccgtcttggcctcccaaagtgctgggattacaggcgtgagccaccgcgcccagccttttctttttttttcctttttaaccacaattaaccagtactaatcagccagagtctagtcattccagataagtagaatgcttccttattttggcatgagttatctttcttatacaattttaaactctatccccaaaggaagatgtcaaactagagaatttcagttacattacaaac

SEQ ID NO: 40705 - DNA, 354 bp, Homo sapiens
gcatgtttggatttgcagtcttttgctttatgaaaagtgctgctgtaaaaattattattatctgtctcctgatgcatatgtgaaagggtttttctaggagtgaaattgctggataatatgtaaataataaacataagaaaatgtcaaattcttttccaaagtagttaatcaagttatactccaccagcagtgtataaggagttctcattgatccatatcttctccaacatttaggtttctcacagttttacatttttttgccagtgaaatgtacataaaatgtatcttatggtttaatctttgtttttttttaactcagtctttctgcttttattctttattctctattgaaga

SEQ ID NO: 40706 - DNA, 421 bp, Homo sapiens
catctatttgtgggcttctggcataaaatgcagctgtcccatatttgctttgtctgtttcccagacaaatcgtctcattgagcttcttccatctcctcgttgggcgccttagttttcccattttgaggctcctagtgagttcctttagtcttgcagtctccagctgccatagacatttttgcctcttcccaccatcactggctccaaagcctatttgcctcctcctccgactgcctatgtgagccttcctccgtctgactgcctttgtgagcctttcagtttaggaaccccccaatccccctgccctcaaagcttttgaatatcctcacaatttccttctttgaaaacattttcactccttccctcaaccccaaccccatgtggtcttctcaggccttttgtggaaatgatgatgaagaga

SEQ ID NO: 40707 - DNA, 500 bp, Homo sapiens
  misc_feature 27, 45, 47, 467: n = A,T,C or G
tatggaccgggaagggaacaacagggnaattaacttggcccagcntnactgtttgtggggctaacaccctgtgtatctcacaccaaccctaagctttgtttccctcctgtcactttactcctatttctttcatatgaaagaatgttcattttctttgaaaatgagctcatttcctcattttctttccatctttcagcaggaacaaagatcaccacaactggctccccttcaactatgttagatggcaacttgccttcagtatggtgaaacacatcagttaagactggggttgtgcatggcaggactttctacaaggacacccagtctccttaataaacatgagatgctctctttccagaagttctcttgcctgacacagcataggaagatgctgaacggccacacagtgacccattgagatagaatctcactatgttgaccaggctggtcttgaactcttggcaccnaagcgatccttttgcctggaatcccaaagtgtc

SEQ ID NO: 40708 - DNA, 248 bp, Homo sapiens
ctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttcc

SEQ ID NO: 40709 - DNA, 467 bp, Homo sapiens
gcagaccacccgtagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacatcgatttggacagctcaccaacccctgaaggggccgttcagcctggttagttttctacctactccgagtgtcctcccctgccccaccagattgctgcaggggcgcggtgtgcctggcagccaaattattgacacttcttttttcctatgcactggttttacacagctgtcatttttctttcaaaattgcagcagtcccacagatgtgtgcatttggacaaatagtacttaaaaacaaaacaagcactcagcccagctcctcaatactacctggaaaaagcattggcattatttt

SEQ ID NO: 40710 - DNA, 464 bp, Homo sapiens
tcccagcgtgctctgcgaggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttc

SEQ ID NO: 40711 - DNA, 418 bp, Homo sapiens
taagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtc

SEQ ID NO: 40712 - DNA, 132 bp, Homo sapiens
ggatgaatgaagctccatttgtaatcagcatgaagccaaataagtcatcagaatggcgcatgcttcattaagactgtgatcatatggcattttcataaggaagttacaagtcttaaaaggaccacaagtgac

SEQ ID NO: 40713 - DNA, 397 bp, Homo sapiens
  misc_feature 19: n = A,T,C or G
caagcacagtacgacaagnaaaccagggggaaagaaaaattaaggaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatg

SEQ ID NO: 40714 - DNA, 378 bp, Homo sapiens
catcgaagaaattggtgtatttttcaatttattcaggttattatttgtataaaaatgaaatttggttatttcttttcctataggaggcccatgattccatagatttcttctgattgggatcattgtaatacatgtttcgtttatcttcctgatttgaactgtatcttccttgagttctatcaatcgctcttcccttcattcaaatttttcataacattcttatatttatttgcatataaaagtttaaatttatttatattaagcatatgaataccttgaaaaatttcttgggggggaaccttttcttgcgggatatggaaaatattttcatgacatcaatttcctgaggtaaaaaaagttgaggtttgaagaggatgc

SEQ ID NO: 40715 - DNA, 442 bp, Homo sapiens
  misc_feature 7, 41: n = A,T,C or G
aagtganctggctgcactactctagcagaccccagcctagnatcagccatctcatatgataaatacattgcatattgttttatacactgagattttcagttgtttgttttgcagtaataacaaagtatacatctggcaaagtcaaaattagatgttggcaattatatggaggaaaaagaggttctctcattgacgctgatggggaagtaaattaataaaattcctttggagagtaatttgacaatatctaattgtaaagttgaagatgcccatatcctgtcagaaattccacctctaaatgcattcactagagaaacacacatataagcaaagaattatttaaaagatgttcattgcagcatgctagtagtgaaaaattttaaacaacctaagagtccaaaaggagaataatgatgaataaattatatggtagtcatcaatg

SEQ ID NO: 40716 - DNA, 158 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgtctgtctgggcgtcgcttg

SEQ ID NO: 40717 - DNA, 133 bp, Homo sapiens
gcttcatccgccaactaatatttcactttacatccaaacatcactttggcttcgaagccgccgcctgatactggcattttgtagatgtggtttgactatttctgtatgtctccatctattgatgagggtccca

SEQ ID NO: 40718 - DNA, 416 bp, Homo sapiens
  misc_feature 33: n = A,T,C or G
atttgccgtgggctttctgtgggttagatgtanagcccacatattttaatattcactattttaaatgagcatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaagtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactg

SEQ ID NO: 40719 - DNA, 315 bp, Homo sapiens
gtcccctccaaagtaaaagacaaacttgcatcttgcatcctcaacagaaggaaggaagcacactatttggtgagcttctctgggtcctggcaacaccacattccacatctaagtatattgtttggcccactgtctgggtataatataggaagaggtcagctttgagtgcggactagacaggaagggacactgcagcagatccaggcggtggtgtaccaggtcatcaactctcagtcccctggtgctgggggtgacagcgtggggaaagatgctagatggagctgaaccaagcagctgagatcaagtgagctgaga

SEQ ID NO: 40720 - DNA, 265 bp, Homo sapiens
  misc_feature 23: n = A,T,C or G
gctctcttggtatacttcccagnaaattgagaaagtaaattattcaaattgctggagaacaaatctctttgctagtcaggtgcttcctagttcactgtttaaaagaaatgaagaaggactttatcaaattgtcatgtgcccgaagattaaaaatatttttgctaatagaccattacacaaatgttgacatataacatagaaggaattcaaagaactgaattacattgctataataaaacactctcaattccttcaacttacatct

SEQ ID NO: 40721 - DNA, 258 bp, Homo sapiens
gatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagcccg

SEQ ID NO: 40722 - DNA, 320 bp, Homo sapiens
tatggccgggagaaaaccaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtg

SEQ ID NO: 40723 - DNA, 490 bp, Homo sapiens
taagacaccatgagcaacttcctaaattcttgttacatagaaagtcaagtatttgttttcctctctgcattcttccttttgcaccattcctagtggcttctgtctttctgtgtcaaaaaaataaaaacaaaaatagaaaggatccattaaggagttttcccaataagaggtagtcctctttaggaagacttctttcattcttctaaaagaaagcagcactactcaataaaactttctgtgattatagaaatggtctctaatctttgctgttaaataaggcagccactaattatgtgtgactattatgagctttaaatatggctagtgcaactgaggaacattcagttaacttaattttaaactgaaatagccacacgtgactaccgagtatcatgttgaacagcacagttttagatgatctgcttcaaagtatagtcagctttttcttcctgttaaacatctattgcctttaattttttgaattaaaatg

SEQ ID NO: 40724 - DNA, 488 bp, Homo sapiens
gctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggtcaccagagtcaccaaccccaatgccaggctgcgcagtgaagaaaatgagtaggcagctcatgtgcacgttttctgttt

SEQ ID NO: 40725 - DNA, 163 bp, Homo sapiens
  misc_feature 11: n = A,T,C or G
tgcaacaaganttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatt

SEQ ID NO: 40726 - DNA, 350 bp, Homo sapiens
  misc_feature 4: n = A,T,C or G
gtcnacgaggagatcaacaaccggtacaatgggaagctcagctttggtattctgtgctgcacactccacgtttacccagaagatgtgtaattgcttctgagaagctgaggccaggagcagatacctctaacaagcgtgttctgagtgttctctatgagacctgggagctggaccaggttgtttcttagcgctacctccagctctccctcattgttcttcttttgatatagacatcgtgatttggaggaggaatgccttggcagccagagtggagcagttgaaaactgtgtatcataaaaatgaaaatgcattctcttaagtttgtgggcgcttgtgtcaaggcctgaaga

SEQ ID NO: 40727 - DNA, 252 bp, Homo sapiens
gggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttt

SEQ ID NO: 40728 - DNA, 349 bp, Homo sapiens
  misc_feature 32: n = A,T,C or G
ataccctggaatactatgcaaccataaaaaangatgaattaatgttctttgcagggacatggatgaagctggaaatcatccttctcagcaaactaacacaggaacagaaaaccaaacactgcatgttctcattcataagtgggagttgaacaatgagaacatatgggcacaaggaggggaacatcacacactggggcctgttgtggggcgaagggcaaaggggcgggatagcattaggagaaatacctaatgtagatgacaggttgatgggtgcagcaaaccaccatggcacatgtatacctatgtaataaacctgcacgttctgcacatgtatcccagaacttaaagt

SEQ ID NO: 40729 - DNA, 483 bp, Homo sapiens
  misc_feature 5, 6: n = A,T,C or G
aaatnnccagttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgggcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaaga

SEQ ID NO: 40730 - DNA, 462 bp, Homo sapiens
  misc_feature 30: n = A,T,C or G
gatcaacactatacaggaggatactccttnattcacgtaagagtgttgaccaaaggattactaaggacagactttgtcatcaaaagaaggacataaaggttaaatgtgagaggaaaaagtggggaagtctcatgatgaggttgggagtgactgcagaaacagccccataagacttctaagagaaaacagcaggtgcatcaacagaaaagggcaaggatgagactgaatcaaaacaaatacctgtatcatagcatgattttcacagccacaatacagagtaggagttaacaatattgagactgaagtctgaccctctaggtttaagaaggtcacctccctcattcagtgactatgtgaacttaggaaaattacttatcctctatattacttacatttaaaaactggggacaattatagcatttacctcattgattgctaagaggataacgaggaagagtttgt

SEQ ID NO: 40731 - DNA, 414 bp, Homo sapiens
aaagaaccttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaaaaagggggaaaatcataaatacaatgaatcaactgaccattacgtagtagacaatttctgtaatgtccccttctttctaggctctgttgctgtgtgaatccattagatttaca

SEQ ID NO: 40732 - DNA, 472 bp, Homo sapiens
  misc_feature 4, 6: n = A,T,C or G
agtnangcaaccacagaacaaaaataaagatgacagcagacatcttgttactgaatttaccaaaagagaatttagtgtaatatcattgttagagaactgaaagaaaatactgtcgacctagaattctatatccattccatatctggcaaaaatatctttcaaaaacgaaagcaaagtaaaggcattttcagatattcaaaagctgaaagaactcaccaccagcaaacctgcactacaaaaaatgctaaattcttcaggcagaaggaaaataataccaaacagaagcatggaccaacacaggaatacagagcactggaaatggtaacaacatagggcaattatataagatttcttattgattttctttaaaaggtaattaacagtttaaataaaaataacaatacattgtgggatttataacctatgttagaagtaaaatatatgataacactagaataaagctgagggggta

SEQ ID NO: 40733 - DNA, 160 bp, Homo sapiens
atttttggaatatagtgaaagacttaattcaaaggagatttattgaccaaaaagcttatttagaaaagaaaaaaggccagaatgttgggacctaagaatctaacttgagaagttagaatgagaggaacagattaaaccctgagaatggagaaagaaggaa

SEQ ID NO: 40734 - DNA, 238 bp, Homo sapiens
atttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaact

SEQ ID NO: 40735 - DNA, 426 bp, Homo sapiens
  misc_feature 63: n = A,T,C or G
attctatccattaatatcagtcatcctgcagttattcagttcaacaaatacttactatgaggntactatgtactggaatatatactctgctcttcaagagattacaatctagtgagggagaaggataggctttagactctttgtatgtatatatgactgagttcttgaaactcacatatcagaactgactccaactacagtttgtaggtcttagggatcttccactgaagcagactatttagaatttctcctccccaaatctgcatcctgtagtacacctcttatttcttttgtaaagtttgttggcagagcacagtgctcacacctataatcccagcactttgtgaggccgaggtggatggattacttgaggccaggattttgagaccagcctggccagaatttgtttggccagaatatggtctg

SEQ ID NO: 40736 - DNA, 488 bp, Homo sapiens
  misc_feature 2, 10, 33: n = A,T,C or G
gntctccagnaggcaataggcatatctaaagcnctgtgaagatgtccaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctag

SEQ ID NO: 40737 - DNA, 482 bp, Homo sapiens
  misc_feature 30, 31: n = A,T,C or G
ggctctctgggtagcagggtggtgtgatanntgcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccctatcaatttcaccatgttcctcaccatgtttggcgagaagttaaatggcacagatcctgaagatgtcatcagaaatgcctttgcttgctttgatgaagaagcaactggcaccatacaggaagattacttgagagagctgctgacaaccatgg

SEQ ID NO: 40738 - DNA, 438 bp, Homo sapiens
ctaacccactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaaga

SEQ ID NO: 40739 - DNA, 471 bp, Homo sapiens
  misc_feature 33, 34, 141, 150, 315, 348, 350, 414: n = A,T,C or G
gtaaaacaatctgatgtactgaagattcttaannattatgacagagaagccacagggaaaatcacctttgaagattttaatgaagttgtgacagactggatattggaaagagatccccatgaaggaatactcaaggcattnaaactattngatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggngacatttaaagaattacaaggataaacactcanantgttgcagttaccatcttatattctatttttgtgcctggagccatgtgaaaaaaaccaacttanttcttttatcctaaaggaccaaaaataagcatcttatatatctgtattttactactg

SEQ ID NO: 40740 - DNA, 381 bp, Homo sapiens
  misc_feature 28, 33, 34: n = A,T,C or G
ggcgcacttgtgccctggttcgccaagnatgtnnttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggatagggaaagaaaaacttatccagg

SEQ ID NO: 40741 - DNA, 321 bp, Homo sapiens
  misc_feature 8, 32, 33, 163, 303, 310: n = A,T,C or G
atagcacncacttcatcagatattagaattanntcacactattgaggttataatgctgaaggttgtgttacatagaaaccactttagattattatcaacttggactaggctttattttataatagcatagtaagtaatatctattgtgtcatttcttcacccntttttattctaagacccatgaagcttcttgaggccaaataaaataataagtttagacaagaagtagattgtgactttttttcccttagagatactattacttctcctcctatcctgataggtggaagggtttactgaatnggaaatnggggggactat

SEQ ID NO: 40742 - DNA, 258 bp, Homo sapiens
gaacacacggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtg

SEQ ID NO: 40743 - DNA, 391 bp, Homo sapiens
  misc_feature 32: n = A,T,C or G
tgatgacagatttgagagctcaaatcctttantgggccactgaaacttctctctagatttaaattcaattctgtaaacatatattcagtatttactttataatggactgtacttaattcagtgatgaacaggatatggtggtagtctcaagcacatcatcactctacagtgggagaaagacatccagaaataaccatggtataaaatattaagtataataacaaagttgtgaacaaggaacacaaaggagaggccagtaattatctgggagaagtgaatgatgcataccaaaatgagggatatttgagccaagttttgaaagagaaggagatgtttgtgagaagtacaagaaaagagtctgattgccattcattaatcagcatttattcat

SEQ ID NO: 40744 - DNA, 409 bp, Homo sapiens
  misc_feature 32, 58: n = A,T,C or G
gggggccttcctgaagctgacagcattcgggncgagatgtctcgctccgtggccttanctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatgga

SEQ ID NO: 40745 - DNA, 114 bp, Homo sapiens
  misc_feature 83: n = A,T,C or G
caggaggctgaggcagaattacttgaacccaggtaggcggaggttacagtgaacccacatcctgctattgcactccagcttangcgacagcagcaaaactctgtctcaaaaaag

SEQ ID NO: 40746 - DNA, 436 bp, Homo sapiens
  misc_feature 7, 31: n = A,T,C or G
gaactcngtggtggccctgcgcagaccatanttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtg

SEQ ID NO: 40747 - DNA, 276 bp, Homo sapiens
  misc_feature 32, 33: n = A,T,C or G
attgcacgccagataaacacttactgccgtannatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcg

SEQ ID NO: 40748 - DNA, 304 bp, Homo sapiens
  misc_feature 3, 52, 55, 56, 109, 111: n = A,T,C or G
agntttctaacaagctgacgctggaaaagctggacgttaaagggaagcgggnagnnatgagagtcgacttcaatgttcctatgaagaacaaccagataacaaacaaccngnggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccaga

SEQ ID NO: 40749 - DNA, 500 bp, Homo sapiens
  misc_feature 49, 74, 120, 177: n = A,T,C or G
gcagaggcttcatcaaggcactacccctaatgttaggtccttcttacanatcagcccacgtagtcctcacagcngctggttgaggagctattatcatcatccccacttggcagtggtacngtagaggctgaggctgagagagttgcccaggttcactctactggaaggagccagctntggaatctggaattcagccccaggcctctctcagtccaagtccagtgcgcactatctctttcatggactgcctcccattctcaggatcctaatgtctttatctaaccctgctggtggccagaagcctctacctggtacccgtcacaacccaggtgagaccaggcatctcaagatgcctcacctgacttccagctggaatccaacctgagctgtgcagttggctcaaagggtggccaaccagaggagcagatttatccacattggcatcagaaaaaccactctaggccgggcacagtggctcatgcctgtaaggctcatgcctt

SEQ ID NO: 40750 - DNA, 350 bp, Homo sapiens
  misc_feature 34: n = A,T,C or G
ggttgccggggacgctgctgtaagaggagtatanatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgact

SEQ ID NO: 40751 - DNA, 371 bp, Homo sapiens
  misc_feature 32: n = A,T,C or G
atggttctcatacaatgcaattattattcagnctaaaaatgaaagaagttccgatacatgttacaacttggatgaaccttcaaaacatgctaagtgaaagaagccagacatgacacatcacatattgtttgattccatttatatgaattgcccagaagagcaattccatagagacagaaagtagattattggtggccaggggctgggcagagagaggaatgggggatgactgctaatggaaacagtttcttttaagggtgataaaatattctagaattaagatactggtgatagttgtacaactgcgaatatactaaaaacactgaatttgacaatttaaaagggtgaatttcatggtgtgtgaattatat

SEQ ID NO: 40752 - DNA, 356 bp, Homo sapiens
  misc_feature 33, 77, 96, 207, 302, 334, 351: n = A,T,C or G
ctctactaaaaatacaaaaattagccgggcgtngtggcgggtgcctgtggtcccagctgcttgggaggctgaggcangagaattgtttgaacctangaggcggaggttgcagtgagctgggatggtgccattgtactccagcctgggagacaagagtaaaactccgtgtcaaaaagaaaaaaaaaaattacctgggcatggtatggnggcaggcgcctgtagtcctacctacttgggaggatgaggcagggagttgcttgaacccgggaggcggacatttcagtgagccgagattgcccaanatcgcaccactgccctccagcctgggcaacanagcgagactccgtctcngaaga

SEQ ID NO: 40753 - DNA, 151 bp, Homo sapiens
  misc_feature 19, 56, 72, 78: n = A,T,C or G
cctataattcttgtgctgntggatatcacccccatgatgggtgtcctggacggtgncctaatggaactgcancactgngcccttcccctcctgaaagatgtcatcgcaacagataaagaagacgttgccttcaaagacctggatgtggcca

SEQ ID NO: 40754 - DNA, 316 bp, Homo sapiens
  misc_feature 130: n = A,T,C or G
gaagaagcaagcagcgagtcttgaagctctgtttggtgctttggatccatttccatcggtccttacagccgctcgtcagactccagcagccaagatggtgaagcagatcgagagcaagactgcttttcangaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatg

SEQ ID NO: 40755 - DNA, 127 bp, Homo sapiens
  misc_feature 17, 33, 124: n = A,T,C or G
ggaagcggaaaactggnaagacagaagtacggnaaggcgaagaaaagtaatagagaagatagggaaattagaagataaaaacatacttttagaagaaaaaagataaatttaaacctgaaaagtngga

SEQ ID NO: 40756 - DNA, 371 bp, Homo sapiens
  misc_feature 366: n = A,T,C or G
gggaaaaagtatatatatacacacacacagtacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattangagtg

SEQ ID NO: 40757 - DNA, 248 bp, Homo sapiens
agtgttaagatggtaaatcttattaggtatattttgccacaattaagaaaaagaaattaataaaaatgtcaatagtaatatagtggaccacacaattagaacaaagaaatctcaattctacttctggcttgtctattaactagcagtatgagcttgaacaagtcaataattctttgtgtgtttagtgaaagaatctaaactgtatataatcttaaggccctatcttcatgttgtaacccccccctccc

SEQ ID NO: 40758 - DNA, 301 bp, Homo sapiens
  misc_feature 6, 72: n = A,T,C or G
gacgcnaaacaaattgcaatataatgtgataagttctttaaaagaggtaagagcaacgtgctttgggagcanagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttct

SEQ ID NO: 40759 - DNA, 116 bp, Homo sapiens
cgcagtgggtccacctgtgatcccagcacttcgggaggccaaggcaggcagatcacgagatcaggagtttgagaccagcctggccaacgtagtgaaaccctgtctctactaaaaat

SEQ ID NO: 40760 - DNA, 402 bp, Homo sapiens
  misc_feature 3: n = A,T,C or G
gtncaaatatttagctaattttgcttttaataactgtataaattgtaattatcatcttttaccactggatggtgcttttccattggttactgcaaaccctttctaaatttacctaagggcaccatttgaaaattcatttaaaaaacaaatgaaattaagataatggtatagtttcccatctcagcctgggcaacagagcaagactctatctcaaaataaagaaaaattgtccctggtaattattttgtcttttctcctatccagtagctgttcagactcctttcactgaagcccttttatttcacaaatactattttcaaattctgcttttttagctaccaaatgactttttgttagctaccctacttaaatgagttgagtacttaagtctatagagtctat

SEQ ID NO: 40761 - DNA, 276 bp, Homo sapiens
tatcagcaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttg

SEQ ID NO: 40762 - DNA, 213 bp, Homo sapiens
  misc_feature 116: n = A,T,C or G
gaagtgacggtggcgtttccttgaggaagagtgagggttccaacttttctgcttatctgggaggtgttgggcgcggacagtcgagatgtcagagaaaaaacagccggtaggcttangtctgttagaggaagacgacgagtttgaagagttccctgccgaagactgggctggcttagatgaagatgaagatgcacatgtctgggaggataattg

SEQ ID NO: 40763 - DNA, 470 bp, Homo sapiens
  misc_feature 6, 7: n = A,T,C or G
gcaaanncaaacaaaatctgctccatagtgaataacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttagga

SEQ ID NO: 40764 - DNA, 333 bp, Homo sapiens
  misc_feature 13: n = A,T,C or G
ggtggtcctgatnaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 40765 - DNA, 349 bp, Homo sapiens
tgaatgaagcctcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttga

SEQ ID NO: 40766 - DNA, 220 bp, Homo sapiens
  misc_feature 11, 18, 29, 34, 47, 95, 176, 192: n = A,T,C or G
gtgagaccgtntatgctnatctgggaggngttgngcgcggacagtcnagatgtcagagaaaaaacagccggtaggcttaggtctgttagaggaanacgacgagtttgaagagttccctgccgaagactgggctggcttagatgaagatgaagatgcacatgtctgggaggataatngggatgatgacaatgnagaggatgacttctctaatcacttacga

SEQ ID NO: 40767 - DNA, 467 bp, Homo sapiens
ggactctttcctgtcccggcctgcgtggtgtgggcttgtgggtctttgagacccgaaaattgagagcgttttcgcactccaggggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatggga

SEQ ID NO: 40768 - DNA, 353 bp, Homo sapiens
  misc_feature 77: n = A,T,C or G
aattttagtactttttaattatgcaaataaatcaatgtttccttaaattttgtcattgctttgtcacagttgtctanggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatg

SEQ ID NO: 40769 - DNA, 341 bp, Homo sapiens; identical to SEQ ID NO: 31110

SEQ ID NO: 40770 - DNA, 394 bp, Homo sapiens
ggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtac

SEQ ID NO: 40771 - DNA, 278 bp, Homo sapiens
  misc_feature 21: n = A,T,C or G
gcactgaagaggagagcgagnatagtagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgc

SEQ ID NO: 40772 - DNA, 356 bp, Homo sapiens
cagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaacgaaactcctattataaatttaagataatgtaatgtatttgaaagtgctttgtataaaaaagcacatgataaaaggaat

SEQ ID NO: 40773 - DNA, 260 bp, Homo sapiens
  misc_feature 26: n = A,T,C or G
ggagagagagactggagacgcacagnatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccg

SEQ ID NO: 40774 - DNA, 209 bp, Homo sapiens
ggcaaaaaataaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactgatgtcattattttgaaaaaataaatttaaaaatacattcaaaatt

SEQ ID NO: 40775 - DNA, 352 bp, Homo sapiens
ctattctattgacgaatgtttcacattttctcaaacgtttcgaggaaatataaaaatatgttgccccaacttcctttccaatttccaaaggaacattttggctgggaattaggaaaatttcgttctatgtataacatctacgaagatgtttaaactgtaattgcatgccatttcaaggaaatgttctttcagtacagtgaagactgacctactcgggaatattaaaatgtacaggggttcacattttggtgataatattttatcattttgaaaacttattcttaatacacccccacattacattttagtaaaatggtttcactttctttaacacccattaatagctattaga

SEQ ID NO: 40776 - DNA, 394 bp, Homo sapiens
agagtgacattttgcctcctaccaactgtcccaaccctaaacactcatatccatgagctggtttaataatttaagatggaaaaagcaaagggggtctaaaggactctgccagccaagaatccagaagcaagggctactagaattctgcagctgacagtggatggtgcaggtgcagaattgcatacgtctgcatgttatcactgccgcagaaatctcttacccttgctgcagaaatcagccctggagtgccccagaattccaagggcctgggtatgggccagtgtagctttggaaccaagtagtgaagattatctgaaggataatttttctagtcaaccaaatgtaagtacagagatttcctacccatctttttttgtggtcgtgatgtctgtga

SEQ ID NO: 40777 - DNA, 470 bp, Homo sapiens
catctcatcccagttaaaatggctttttatccaaaaagaggcaataaccaatgctagtgaggatgtagggaaaagtgaaccctgtacactcttggtgggaatgtaaattaatataaccactgtggagaacagtttagaagttcctcaaaaaactaaaaatagagctaaaactaaaaatatgatccagcaatcccactgctaggtatatacctaaaagaaaacaaattagtatatcaaaaaagtgtctacactctcatgtttcttgcagcactattcacaactaagatctgaaagcaacccaagtgtccatcaacagatgaacagataaagaaaatgtggtattaatacaatggagtactatttagacataaaaataaagagattctgtcatttgcagcaacagggatggaacctggaggtcattacgttaagtgaaataagccaggcacagaaagatgaactttacgtgt

SEQ ID NO: 40778 - DNA, 469 bp, Homo sapiens
  misc_feature 8, 116, 118, 145, 149, 196, 267: n = A,T,C or G
atcaccancattcctgcaaggtcttcctccttcccttacggaattacatcttgatggcaacaaaatcagcagagttgatgcagctagcctgaaaggactgaataatttggctaagncngggattgagtttcaacagcatctctgntgtngacaatggctctctggccaacatgcctcatctgagggagcttcactnggacaacaacaagcttaccagagtacctggtgggctggcagagcataagtacatccaggttgtctaccttnataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatt

SEQ ID NO: 40779 - DNA, 187 bp, Homo sapiens
ggcaatgcttttagattaaaatgaaggtgacttaaacagcttaaagtttagtttaaaagttgtaggtgattaaaataatttgaaggcgatcttttaaaaagagattaagccgaaggtgattaaaagaccttgaaatccatgacgcagggagaattgcgtcatttaaagcctagttaacgcatttact

SEQ ID NO: 40780 - DNA, 435 bp, Homo sapiens
  misc_feature 24, 27: n = A,T,C or G
ggctgatatgaatgtatcaacagnagnagtgaatataatgggatattatagtgaatggtaactttaaagaaaataaagtgattttcatacaaattattaatcttacatttcaacttttcaaaatgtatgtagacaaatttatttcattactttgcccctgaaaatgcctgtgaaatatctcataatccctgaggaccgtcttttgaagattctgagagaaaacaagaagggctaggactgagccatgagaaactctaaaagttacaagctgaggagaagtcaaagtgcaaaggagactgagaatttatggacaaaaaaataagatgatctggagagtgtcatgtcatagaaaccaagagaagagttattcaggacagaggataaactgtgaaatgttaccgtgagataagtaagatgaggactgaaaagagcata

SEQ ID NO: 40781 - DNA, 272 bp, Homo sapiens
  misc_feature 16: n = A,T,C or G
gggaaattcacaaagnatgtgaaaattaaacaacatactgctaaataaccagtgggtcaaagaagaaatcacaagggaaattagaaaatactttgagattaatgaaaatgaaaacacaacataccaacacttatgggatgcatatataacagtgtttatagagaaatccgtaacagtaaacacttattttttttaaacaagagatctcaaatcaagtctcacctttcatcttaagaaactagaagatgaccctagtaaatcaaagtaagcag

SEQ ID NO: 40782 - DNA, 207 bp, Homo sapiens
  misc_feature 34: n = A,T,C or G
aggggaagtgatttgcagagtggccagtacaggntcagtgggggcatagacacaggacatgtgacatatgtggttataagcagagaaaggaggcagcgagtgggagaagggtagcagccaccgcgcccagcccagtgagccatgattgcaccactgcactccagcctgggtgaccggagtgagaccctgtcaaagacaaaagcaaac

SEQ ID NO: 40783 - DNA, 481 bp, Homo sapiens
  misc_feature 60: n = A,T,C or G
atgattacagggacatctcaggctgactgtgctgtcctgattgttgctgctggtgttggngaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactg

SEQ ID NO: 40784 - DNA, 183 bp, Homo sapiens
cagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgcc

SEQ ID NO: 40785 - DNA, 472 bp, Homo sapiens
gaagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcatta

SEQ ID NO: 40786 - DNA, 358 bp, Homo sapiens
catgtcccttccctttactctgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttg

SEQ ID NO: 40787 - DNA, 194 bp, Homo sapiens
ggcgcaatagatatagtaccgcaagggaaagtatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagc

SEQ ID NO: 40788 - DNA, 490 bp, Homo sapiens
  misc_feature 33: n = A,T,C or G
aggcagggtctatgcccataacatcagcaggangcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacccctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcaccaactctgggcacactgcctataggttagccct

SEQ ID NO: 40789 - DNA, 361 bp, Homo sapiens
cggccggaaccgccatcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtg

SEQ ID NO: 40790 - DNA, 273 bp, Homo sapiens
  misc_feature 19: n = A,T,C or G
caagcaaaggcaaaccagnatctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaaccct

SEQ ID NO: 40791 - DNA, 387 bp, Homo sapiens
  misc_feature 55: n = A,T,C or G
tgcctttaatgtcttgaacattttaaattacttctattaccatgttgttttttanctagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacagtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttgaga

SEQ ID NO: 40792 - DNA, 227 bp, Homo sapiens
caaggcaaagtctgcctgtggctgcagcagtagctccttcccacttacccaaagctttgagctccaataaatcatctcaggaatacctggaaaatggaagagatgaggcgctctccctgtagaggggaagaaatgggagcacagaaaggacttggctcagagcctctttctaggaaaacatcaacttccttttgattttccaggcatcaaagaaaggtctatgcata

SEQ ID NO: 40793 - DNA, 377 bp, Homo sapiens
  misc_feature 24, 369: n = A,T,C or G
tatgatctacttgtataaatttancttctctatagctggcctattccccaaagaagtatacatggcttataaaatgcacaaaatacaatagaagaaaataaacataagtaagtaaaatcaggaacaggtaaaatataaatttgaatccaaggttaagactggagaaaagtagaatgcagacaggtatgtcctactgagttattaaagtcaagttgcaaatttggctctgggcttcctggaggctaaacagctagaaattaatggatagactaacagattttgatatgctatcagtgggaaaaatgtattttccattagccgtctaattctttaatacttcacactaaatatcctatgcagataaagttnaaatatgg

SEQ ID NO: 40794 - DNA, 462 bp, Homo sapiens
atatgagagtaacctataccacccttttcctcagagtaatctctagcctctcactgttagttcgcattctgaatctttaacccttccaaaaaggccaagcccagcccttggcactgtcccctatgacagagctgagctcctccatcaagctcagtggcagaacgatcctttcctcctttccaagatgactgcccagaatcacagaaacctgtaagaatggaaagagagtaatcccaattctgggcattcacccaaaagatttgaaatcagttggttgaagagatgtctggactcccaggttcactgcagcattagtcacaataaccaagttatggaattagtctgagtgtccatcaacagatgaatggataaagaaaaggtgggacatacacacaatggagtactatttggcctttaaaaagaaattctgttgttttcagcaacatgggtggaatttgaaga

SEQ ID NO: 40795 - DNA, 127 bp, Homo sapiens
  misc_feature 32: n = A,T,C or G
ggactatcaggatccggagacggaaatgtccnaaggccgcagtacttgaccctgtattttgggagtcgaacggagaatggaagctgaaagtggaaatcaggaaaaggtaatggaagaagaaagcact

SEQ ID NO: 40796 - DNA, 416 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacac

SEQ ID NO: 40797 - DNA, 126 bp, Homo sapiens
  misc_feature 6: n = A,T,C or G
atctgnagaagttttgctttgttgatctgagccttctatgaaagtttaaatatgtaacgcattcatgaatttccagtgttcagtaaatagcagctatgtgtgtgcaaaataaaagaatgatttcag

SEQ ID NO: 40798 - DNA, 430 bp, Homo sapiens
  misc_feature 7, 27: n = A,T,C or G
aacgcancctggctcgtggtcccaagnaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtga

SEQ ID NO: 40799 - DNA, 121 bp, Homo sapiens
atatcaataaacacacagggctagggtcccaaactctcttgcatttgttcagaagcagtagggaacccttacttatgggcagtctccgatgtctttgccctcctgcagaagcaatcccttg

SEQ ID NO: 40800 - DNA, 396 bp, Homo sapiens
  misc_feature 14: n = A,T,C or G
gtatgtatataatntgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattg

SEQ ID NO: 40801 - DNA, 324 bp, Homo sapiens
attatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttcca

SEQ ID NO: 40802 - DNA, 244 bp, Homo sapiens
ggtgtgatcacagctcactgcatccttgacctccccaggctcaggagatcctctctgcttaggctcctgagtagctgggactacagggtgtgccatcacacccagctaatttttgtttttatttgtagagacagggttttgctatgttgcccaggctggccttgaactcctggggtcaggtgatccacccacctcagcctcacaaagtgctgggattacagacatgagccaccacaactggccg

SEQ ID NO: 40803 - DNA, 469 bp, Homo sapiens
ggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaat

SEQ ID NO: 40804 - DNA, 435 bp, Homo sapiens
  misc_feature 4: n = A,T,C or G
ggtnaaaacaaagaaacaaatagtccatcaactaaaataagctgtaatgaatttagaagatgaatgcatatattagatttccatttaaatcacttctgttataaatcatataaagagctttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaat

SEQ ID NO: 40805 - DNA, 209 bp, Homo sapiens
gcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactg

SEQ ID NO: 40806 - DNA, 427 bp, Homo sapiens
ggtaaacattcccgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcaggcaactaaatcccgaaatacaaaaagtaacacagtggacttcctattaagacttacttgcattgctggactagcaaaggaaaattgcactattgcacatcatattctattgtttactataaaaatcatgtgataacct

SEQ ID NO: 40807 - DNA, 202 bp, Homo sapiens
  misc_feature 7, 32: n = A,T,C or G
gcactancctatgagggtgagctggtcccctntatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgatt

SEQ ID NO: 40808 - DNA, 356 bp, Homo sapiens
agaaaaagtgctatgcagagaattagaatgaaatgtgctacagagtgagcaagggcgtctttcgattggatgatccaagaaggcctcttgaaggaggtgattttaagatgaattctgattggacacaaaggagtgagtgctgtggatgcactgcacaggttgcataagcatatagggccgctcttccaggtccccaaggcaagaatgagtgtgggcagcttcgaggagccaaaatgtggaacattgtggctgaggaacctgtggtgggaaattaggttacaaaggacagttaggacctgtcacctagttctgtggttcccaacctgggctttccattagaaatatcttgcaggaac

SEQ ID NO: 40809 - DNA, 268 bp, Homo sapiens
  misc_feature 9: n = A,T,C or G
tcacacagnagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaat

SEQ ID NO: 40810 - DNA, 469 bp, Homo sapiens
  misc_feature 8: n = A,T,C or G
gagatccnagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggaacagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtgggttttg

SEQ ID NO: 40811 - DNA, 292 bp, Homo sapiens
gaagatgcagaggaccattgtcatccgccgagtactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattctc

SEQ ID NO: 40812 - DNA, 365 bp, Homo sapiens
  misc_feature 33, 73: n = A,T,C or G
gtctgatggaggcttcagtgtatacagatgttngacaactacaacatgaggggagaagggtgaagggacctanatggtagtgaggtttctacatgctacttgaaatggcaaaacattaatctaaattgactgtaagagtatgtgtatttggccgggcagggtggctcatgcctgtaatcccagcattttgggaggccaaggtgggtggatcacctaaagtcaggagttcgggactagcctgaccaacatggcaaaaccctgtctctattaaaaatacaaaattagccaggtgtggtggtgtatgcctgtaatcccagctactcgggaggctgaggcaggagaattgtttgaaatcgggaggcgga

SEQ ID NO: 40813 - DNA, 336 bp, Homo sapiens
ccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttt

SEQ ID NO: 40814 - DNA, 351 bp, Homo sapiens
  misc_feature 7, 31, 33, 58: n = A,T,C or G
gggtgcnttgttacattgaaattgttaactntnacagaaattggtgcatagaggtcangtgctgtcataataaaaatctaaaacatatactgttggctttggtgatgggagtgattggtagctaaagaggcagtgaaacaatgattagtagatactggaaagttaataaggaaatttctattggagggtggagaaagggccacccttgttatatagtggccaaagaatcagcaaaatgttgcctgctgcaacctggaaagtagaaacttttcttaaactcacggatctggctgggagatttccaggatgcatgcaacaaatgtgaatcaactttgtatagctgtgtataat

SEQ ID NO: 40815 - DNA, 187 bp, Homo sapiens
ggccatttaaaaccgccctcgctggagtgttcctgtttgtgaatagacccaccttaaccacccacttgcagcctatgtatccagctgcctggcagaaccctggtaatctgcaccagagctcagggacagcagaaagctgaagaccctttccccaaataacaagcctccttacccaagaaaccatcag

SEQ ID NO: 40816 - DNA, 292 bp, Homo sapiens
gggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgt

SEQ ID NO: 40817 - DNA, 320 bp, Homo sapiens
gacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttt

SEQ ID NO: 40818 - DNA, 469 bp, Homo sapiens
aagtgagttgagactctcaagctgttatttttttccttattctttgggttatttttactaatgtgtttttctgaaatcagtagctattattcctactgattgttattagtaaagtagtacgcactcaacatggtcaataaaacattagaaagtgtttattggcagccggtacagtggctcacacctgtaatcccaacaacaactttgggaggcaaaggtgggagggtcgcttgaacccaggagtttgagatcagcctgggcaagacagcaagaccccatctcttaaaaaaaatgttaattttcaaaatgtggttccacagcgttgatactgggaatatttactagacatgcaaattcttaggccccaccccaaaccagtgaaagcagaaactgggtgggcccagcaatctgtattaacaagcccttcaggtgattctgatgcacactactgttccagaagcactaattt

SEQ ID NO: 40819 - DNA, 168 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatc

SEQ ID NO: 40820 - DNA, 260 bp, Homo sapiens
agtttaaaaaatagctaacagggcgggtgaatcacctgaggtcaggagtttgagaccagcctggccaacatggtgaaaccccatctctactaaaaatacaaaaaactagccaggcatggtggcgggcaactgtaatcccagctactcggggcgaggaggcaggagaatcacttgaacctgggaggcagaggttgcagtgagctgagatcgcgccattgcatccagcctgggcaacaagagtgaaactccatctcaacaac

SEQ ID NO: 40821 - DNA, 412 bp, Homo sapiens
agttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgat

SEQ ID NO: 40822 - DNA, 300 bp, Homo sapiens
gagggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccggtatgtacctttctgcatcttttatcttaacatatagggtgaccccaaacactgctttgaacttcctcaaaattctctctgttggg

SEQ ID NO: 40823 - DNA, 116 bp, Homo sapiens
  misc_feature 16: n = A,T,C or G
agaaataagaaggatnaatagatagctaattgcacagtacatatttgtatatataaaattaatagattttccaataagaataattgtgaaaaactgaccttattcataatgacagt

SEQ ID NO: 40824 - DNA, 470 bp, Homo sapiens
catgctgaagatttgcctattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttg

SEQ ID NO: 40825 - DNA, 105 bp, Homo sapiens
aacataaaaccctcattccacgagaaaacaccctcatgttcatacacctatcccccattctcctcctatccctcaaccccgacatcattaccgggttttcctctg

SEQ ID NO: 40826 - DNA, 371 bp, Homo sapiens
  misc_feature 146, 361: n = A,T,C or G
tccaatgaatgcatgcaaaaatttagtttctaagaatggttattgaattagaatggcaaagattagaaagaattaggtgtctgacaccagggagtggattagacacattttttttttacacccaaataaaataatataaagacagngaagaccaacaatatgagaaaattcttatagtattgtatgaagaaaacaggttttaaaatgatagcagtagtacaattccatttgtgtaaacaaaagtgtctgtggcagggtgtggagactcatgcctgtaatcccagaactttgggaggctgaggccgaaggatcacttgaggccaggaatttcagaccagcctgaaaaacatagcaagattgngtctctctat

SEQ ID NO: 40827 - DNA, 117 bp, Homo sapiens
  misc_feature 2, 14, 31, 51, 88: n = A,T,C or G
antggcccgggaanctgctgccctgctttantttttcctaaatactggganctgacttaccctaggaatgaagagggacaggaagtantctgaggatggagaactcagcaatagtag

SEQ ID NO: 40828 - DNA, 249 bp, Homo sapiens
  misc_feature 18, 21, 29: n = A,T,C or G
cagtgcagctttggttcntanttcagtcntctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatgcg

SEQ ID NO: 40829 - DNA, 467 bp, Homo sapiens
gagcaaaggaaaaatatgatccttttcgacgagcaaatgctgagagaattcatcaccattaggcctgccttgcaagagctcctgaagaaagcactaaatatgggaaggaaaaactgttaccagccagtacaaaaatacactgaagtacacagaccagtgacactatcaagcaaccacataagccaggaaaatagccagctagcatcatgatgacagtatcaaatttgcacataatattactaaccttaaatgtaaatgggctaagtgccttaattaaaaggcacagaatggcaagctgaataaagagtcaagactcatcagtatgctgtcttcaagagacccatctcatgtgcaaagacacacataggctcaaaataaagggatggaggaaaatttaccaagtgaatggaaaacagaaaaaagcaggagtcgcaatcctagtttctgacaaaacagagtttacacca

SEQ ID NO: 40830 - DNA, 251 bp, Homo sapiens
  misc_feature 1, 70: n = A,T,C or G
nagtctgtgaacttggggcattactcagtggatctggaaccttcttactctcaccagttggtttaggccntcccccttcctcttgaaaccaactttgtttgatatgtcattgtagattttctattatttcccccaaatcattccttaatgaacagttcaccttaaatgccttctctttgtatccagaaattatcagctcaaccaataaatagtatgtttgttagtcaagccagtgatccaggaaagacctg

SEQ ID NO: 40831 - DNA, 240 bp, Homo sapiens
atgacccaccaatacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgac

SEQ ID NO: 40832 - DNA, 153 bp, Homo sapiens
  misc_feature 4, 25, 29: n = A,T,C or G
tgantggtttgaggttgtagctctntaanagtagtttttaacctgcctgtagtattgctaactgcaaaaacatactctttgtacaagaagtgcttctaagaatttcattgacattaatgacgctgtatacaataaatgtgtagtttcttaatc

SEQ ID NO: 40833 - DNA, 315 bp, Homo sapiens
caggattaagcgattcctggccaagaaacaaaagcaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttga

SEQ ID NO: 40834 - DNA, 360 bp, Homo sapiens
  misc_feature 7, 43: n = A,T,C or G
ctcggancctaggtcgcggcgacatggccaaacgtaccaagangttgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtggc

SEQ ID NO: 40835 - DNA, 119 bp, Homo sapiens
aaaagtacaaaacattcataagagaaacctgcttacattttgatattaagaaataattccggggattcttccactcctgaaatgagttgatttgcagataactcacaacttcttaagct

SEQ ID NO: 40836 - DNA, 465 bp, Homo sapiens
agtgagagggcagaggaaacactcaatctgtgccctcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtata

SEQ ID NO: 40837 - DNA, 464 bp, Homo sapiens
accttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaagtggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctga

SEQ ID NO: 40838 - DNA, 477 bp, Homo sapiens
  misc_feature 28, 42, 51, 64, 82, 83, 85: n = A,T,C or G
cttggtttgaggcaggggaaagatgaanacttacttgcagcngtagttagngtagagagagaanacagatggctgtagttanngnacaagccgattgtaagcaagtttgcttctcaggggcattggttaaacaacttcttaactggccagggtccagcacgttaatcattaacctagggctgagcatctgctgcctgatgtatccagaattagtttatcattacctctaacgaccatcttttatggttccgaagagcctctatgcagtctcttatcaccgccatgcctaatcttcatttaccgggagcagtgtgctgatgtttcttagttagaccagagtaagaagtttatggtcagttgatgaatttttaattataactgtttaaaaagaagacgatgactatgaacagcagctcactcgtagcaatctttggacagtacttcgaagtgacccactttcccattttaactcttggg

SEQ ID NO: 40839 - DNA, 347 bp, Homo sapiens
  misc_feature 341: n = A,T,C or G
atggcaaaactggaagagtctacaatgttacccagcatgctgttggcattgttgtaaacaaacaagttaagggcaagattcttgccaagagaattaatgtgcgtattgggcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctntgggct

SEQ ID NO: 40840 - DNA, 269 bp, Homo sapiens
  misc_feature 2, 5, 227, 232, 269: n = A,T,C or G
tntanggcccgggggcgccttcatttacataaatattatactagcatttaccctctcacttctaggaatactagtattatcgctcacacctcatatcctccctactatgcctagaaggaataatactatcgctgttcattatagctactctcataaccctcaacacccactccctcttagccaatattgtgcctattgccatactagtctttgccgcctgcgaagcngcggngggcctagccctactagtctcaatctccaacacatan

SEQ ID NO: 40841 - DNA, 125 bp, Homo sapiens
  misc_feature 9, 13, 29: n = A,T,C or G
gattaaacntgtnaaccttttgcctaganttgcaaatctgttttttctccttccttttactactggtgttttacttttttggttatacagaagttgtatattgaaatataatcttgttctgtttt

SEQ ID NO: 40842 - DNA, 404 bp, Homo sapiens
gagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaaga

SEQ ID NO: 40843 - DNA, 305 bp, Homo sapiens
  misc_feature 21: n = A,T,C or G
caaataggaagaacgcacagngggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggca

SEQ ID NO: 40844 - DNA, 472 bp, Homo sapiens
  misc_feature 362, 461, 466, 469: n = A,T,C or G
atagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcactttgtgtgtggcacattgtagccccaaagaatcagcttatagaattaaagtttngagaagtttgatgtggagcgagataactactgccgatatgattatgtggctgtgtttaatggcgggggaagtcaacgatgctagaagaattggaaagtnttggnggngat

SEQ ID NO: 40845 - DNA, 298 bp, Homo sapiens
  misc_feature 256: n = A,T,C or G
gagaaacggaaccagcgggaaccttgacctgagacttgcagcctccagaactgggagaaaatagatttctgttgtttcaagcccccgagcctgtggtattttgtcccagcagcctgagcaggctgaaatggcccatttgttttattttacagggaggaaactgcagctgagtcagctcctctgactctaggccgaccgttcttccctgtatgacatgtgactcaccagataaagccacacacgtcattcttttttnaaaattctctactctgtcccaagttcttgtcccacattccag

SEQ ID NO: 40846 - DNA, 467 bp, Homo sapiens
taattcaaggacctgaagggatggctccacatgatttacttgcatatgatgcagctgtttttagtgctgcatttacatttttaaaaacaagaatgcaccttctcgatagaacagacatgcatttttaactcacaaactcaagaactgtagaaaaaggaagtttcttagaaattgggtccaaacacctttttgtactgaagaaaaagaaactttggtcccaaaagatttagtggcccttaactaagggtcagtcagtaatagaacaaagcaagggactagatggatttccagttcgaggctcttatttgtctcagatctaaaggtacaggtgtggtttatattgacaatttttcatgacatgcagctttttaaggcagtgatagatagcttagccgcttagctacttaaaacctctaacttctgtattagtttattatagcatatttatagtccctgtgactacctat

SEQ ID NO: 40847 - DNA, 316 bp, Homo sapiens
gaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggtgcagagattcttagaagaggaggtgtatcccctgttaaaaccatatgaaagcgtgatgaaggtgaaagcagaattatgtctgtagagttggaagagaattaaac

SEQ ID NO: 40848 - DNA, 309 bp, Homo sapiens
tattggtggaagttttaagtcccaaactgaagggaaggaggcctaggtggcacaatcagggaggaatatacatctgagaagttttgggaagacatcacctggcaaggctgcctgaaccacagtaatttggtcttcctctatccagatcactgagagttgtgtgctggtcttctctcaaaccctggatgtgttacctgcttctccctaagtgctctaacctcgctgaactatgagcctgaagggtgggtcgatgccagaccttaggtggaggccaaagacagtacagaataaacagcttcttcctaaatc

SEQ ID NO: 40849 - DNA, 465 bp, Homo sapiens
ctggaaacagccattgcgatgccatatgttggtcattggtgtccttaaagtgtatctcagataattgtgtgtctcccttacttgtgaactgaggggtcacaatattgatgtgcctgatgtgtgcccctctgcatttcgtgggtagtgtctcaaatttggctatcatattgatgagagttactaatttggttttagctgccagaggtttaggtggttttcactcccagtgacttacctgattgcacatagttacaacgttactggttgcactccttcattgctagcatcttttttctagtatattcgatatacattcttttggtttatcctttaaaatatttgctgagatagcatttaaatgttaatgctgtatttatattttgttggatgcttaattcaatgtgtcttctttccctttccatgaatgaaaagaaattggaagaagagaatcaactatttcgtgca

SEQ ID NO: 40850 - DNA, 154 bp, Homo sapiens
gttcttctatcaataccttattttaccttacagatatttgttgcacaggcagatactgctgtatttagacatttctatttcagttcattaaaaactgcaaaaccaatctgtatcatgtaccaaactgacttaaaataaatctacatgtttattg

SEQ ID NO: 40851 - DNA, 335 bp, Homo sapiens
  misc_feature 307, 327: n = A,T,C or G
caccatgttggccaggctgatcttgaactcctgacctcaagcagtctgcccggctttggcctcccaaagtgctgggattacaggcatgagccactgcgcctggccgttgttaaattttatctaactcattttgctgatcagttcactccactatattgtgtattccttttagtttttaagtcacaagtttgacaagcatgctatcatttggagtatttcagtttgtaatagaaatgttgaaacaaggggataaaactgtagtactacagttttactggaaggaaaatctcaaatggggaactaatgnccagaatgcagcagtgattntagaaaag

SEQ ID NO: 40852 - DNA, 203 bp, Homo sapiens
aaggacactgataaataaactgcaaagggtagagcaagcatagttagagaaaagaaaatgcaaggtagattagtacctacttgctttaagaggcccaaattaattaaagcctgttatactgaaataattttcactggaagatattctttgtgaaaccagagtagacaggagaaacagaaatggcccagtaggcaaatatatac

SEQ ID NO: 40853 - DNA, 434 bp, Homo sapiens; identical to SEQ ID NO: 38912

SEQ ID NO: 40854 - DNA, 127 bp, Homo sapiens
  misc_feature 25: n = A,T,C or G
cacaaccagttgtataacagaaatnctagctactgctttccttcctgtgtgtgaagtaatgaatcattgattctgtgacttgttatgtattcaattaaacactaaagaataaaacattcactcctac

SEQ ID NO: 40855 - DNA, 476 bp, Homo sapiens
gagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttaca

SEQ ID NO: 40856 - DNA, 473 bp, Homo sapiens
gaaaaagacttctaccttcttataattaaaattacacatgtctaagaggaattgttttatcttttgagtagctttaccgagttgtatttaaattctaagggccatttgctaagcagcatttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctaatgcagaaacaaagatgcaacccttcaaaattcttattattcctatttgtatatacacgagagaacccaaccagtgcctgtgtttgggggggaaaagtcaacagtgtagttctaaaccttatcccaaacagaaaatgtggttaatgatgtcactttccttgctggtcatcatt

SEQ ID NO: 40857 - DNA, 469 bp, Homo sapiens
gtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtggtcccagcactgtgggaggctgaggcaggaggatcatctgaggccaagagttcaagatcagcctgggcaacatagtgataccctatctcttaaaaaagaagaagtttttaaatttgaaataataataggtacctggatttatgcaaatgtcttttctgcgtcttttgagatgagtatcagggtttttttttccttttatcatctgatgatgaactt

SEQ ID NO: 40858 - DNA, 230 bp, Homo sapiens
cagctcacagtttcttgcctgaagcttggtgcgccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacag

SEQ ID NO: 40859 - DNA, 467 bp, Homo sapiens
  misc_feature 467: n = A,T,C or G
gattttcttaggctccacaattttggatgtcttgtaatgatatatgtcacctcactccactcagctggctctggcttttccctgattttttgtttgttaatgtcaatttttttatgaccttaactcccacaagtttttgaacttttgattattaatcgcagtgtgttagaattgtgtatcaatcaaccaatgcatctttcaggattagttaaatgattatgttacttaataagaagttttaattcatcgagtaatgtgaactatatgaggatatacatatattaattaatcagctattacctttagaaaacattcttgcatttctgagactaaaaatactcgctttcctattataggtccccttttgcccctccacattttcatatatgcgaaacatatactataattgaaaatgcaaaattagaccttaataagtattttttaagttccttataattagttaaatn

SEQ ID NO: 40860 - DNA, 498 bp, Homo sapiens
  misc_feature 3, 15: n = A,T,C or G
ccngggaattcggcnttatggccgagagagaggtccctcaggctttttctgggttgtttccatgaatgataaagtcattaaacaatttcataggcttgccttattgatctctcacaatggcatgctatgtctgctcttcaggaaagcctttcctgactgcccccatcagagttaattactacttactctgtgttcgcatggccttcttccatcttctattatagcattcatctcaggccaccttgccttacaattacttgtatctctttttcccactagattatgacctccttgaggacggggtgattttcttgttgctctttgtattatcctcagcatctaggtgaatctctgatacatcacaagggttcaataaatgctcattgaattgaattaactggatctgcattccaaggtcatctcttcctagactggtgttgaatgggattcccatgaagtgaggcagcagagtgcgtgcttgctggttctgttgctttg

SEQ ID NO: 40861 - DNA, 200 bp, Homo sapiens
aaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccct

SEQ ID NO: 40862 - DNA, 467 bp, Homo sapiens
  misc_feature 300: n = A,T,C or G
agagcatggtaacctgagatagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtntgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcg

SEQ ID NO: 40863 - DNA, 473 bp, Homo sapiens
  misc_feature 18, 470: n = A,T,C or G
ctattaagaagcattttnaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtggtttttaggttgattcnttt

SEQ ID NO: 40864 - DNA, 301 bp, Homo sapiens
gaattagaagaatcaaggccaggtgttgtggctgatgcttgtaatcccagcactctgggaggctgaggtgggaggactgcttgaggccaggagtttgaaactagcctgggcaatatagtgagaccccatctctacaaaaagttaaaaaattagctgggcatggtggtgtgtgcctgtatagttccagctactcaggaggctgaagtgggaggattccttgaactcagggatttgaggctgcagtgaactatgatcgtgccactgcactccagcctgggcaacagagctagaccccatctca

SEQ ID NO: 40865 - DNA, 471 bp, Homo sapiens
gttttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatc

SEQ ID NO: 40866 - DNA, 217 bp, Homo sapiens
caaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttc

SEQ ID NO: 40867 - DNA, 295 bp, Homo sapiens
  misc_feature 39: n = A,T,C or G
catgtgctatgtaaacgacacacctggtccaaccaaccnatcttttgggccccatgtaaatcaggcaccgccttctcaagcttgtctattaaaacctgtgcatttcatcacaaaactggaggacccgcttgggagcccctctctctctgcaggagagagagctattctctttcttttgcctattaaacttccactgttaaactcacttcttgtcctagatttctctggcatgagacaaccgaaccttaggtatttaccccagacaatgatgctgcttcaagaacaaccaaaaaat

SEQ ID NO: 40868 - DNA, 474 bp, Homo sapiens
agggaaatgggtcttagttggtcttggagaatgaaaggatttatatagacagaaattgagaggagaaacatttcaggcagaaagaataggcagaggactttaaaacggccaatagttcaggttctaaattaaaaaaagaagatgcatatgggatataagactgaaaaagtaggttgtgttcagatcatggaggccctttgactcttgcctaaggagtttgaactttatattgaaggcaatggaggaaccactgactgttttttagcacaataagttggtggattagagctttctttcaggaaagttaatctggctgcactgtttaggatgaatgggagcagggagagacattaaggaaattgtttcaagctagagataatgagggtctgctgaacgaaggcagcagaaatgaggaaggaagggggatgcatatggaaaagatattaagagatagaattgttaagagttaatgtt

SEQ ID NO: 40869 - DNA, 470 bp, Homo sapiens
  misc_feature 410: n = A,T,C or G
gtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgtttgaaggcagtaaactaaagggtgtcaagccccattccctctctactcttgacagcaggattggatgttgngtattggggggttatttttatttttcttcatttttgttctgaaattaaagtatgcaaaat

SEQ ID NO: 40870 - DNA, 467 bp, Homo sapiens
  misc_feature 28: n = A,T,C or G
ctcaacattcaggcaatactctcccccnctaaagattatgactcactaaaggttcaggtgattgttagcatctctgaataataaaatgtttttattttattttatttttttttgagagagagtcttgctttgttgcccaggctggagtgcagtggcggtgatcttggctcactgcaacctccgcctcctgtgttcaagtgattctcctgcctcagcctcccaagtagctggggttacaggcatgagccaccacgcctggctaatttttgtatttttagtagagacggagtttcaccatgttggccaggctggtctcaaactcctggtctcaggtgatctgcctgccagagcctcccaaagtgctgggattacaggcgtgagccaccgtgcctggccaatggagtgtttttaaattaaggcacgtaaagttttttaaaaaaatacaatgctacttcacatataataga

SEQ ID NO: 40871 - DNA, 474 bp, Homo sapiens
aatataggaaagttcttacagtagtgcctggatgtactatttactgtataagtattagctactactactattatttatataagagattgatccaagaaaaggcatccagaatgggcatcagagagagaagacagagtaggaaattgtactgggcatatgatatagaattctctggttgaggagatgaggtctgagaaatcatttacaatttaataaagttattggcctaagaatttgcttaatattcaatagcccaggtacagagcctcaagtaggttgttaattgaatagtccttgtggtagaaaaattggggcctgctatttcaagagtatttgtagactgtggtttgaatcaagtcctgttgggactgggcttattaataaacaaaaagattttgtagagccaaagtatatctttcattagcaaatgtaaaaaataccccaataccacatcaaaattagttgtacaagaga

SEQ ID NO: 40872 - DNA, 471 bp, Homo sapiens
ctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgagatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcata

SEQ ID NO: 40873 - DNA, 473 bp, Homo sapiens
  misc_feature 156: n = A,T,C or G
cttacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatngacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggca

SEQ ID NO: 40874 - DNA, 473 bp, Homo sapiens
  misc_feature 27: n = A,T,C or G
actgacagtttatgtaacattaatttnacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtggggatt

SEQ ID NO: 40875 - DNA, 272 bp, Homo sapiens
aaccaccaaacatattaactctaggctacagcggcatttgatctttatcctggtatgaaacatctctaaagatctcccattatcttagagatattttccaattctgacaaagtctcaaagttggcataaattgttaaagtactatacctttttttggaggttgaagaatattgttccctcctgtgcttccaaaaagttctggaaagttgtacctaggacttaaataaaatcttagttttccactgtcttttaaatttgagatgtatgcttac

SEQ ID NO: 40876 - DNA, 387 bp, Homo sapiens
  misc_feature 359: n = A,T,C or G
atttgttgaatctgaaatgatgttgccgccttgtataacaatggttatgtgactactgttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtacgtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaattnaataaatatactctagtatgatcagcct

SEQ ID NO: 40877 - DNA, 472 bp, Homo sapiens
  misc_feature 12, 86, 94: n = A,T,C or G
aatggacacagnagtaagcatttgacaaaatgtctaacaaccttttattctaaaatctctcaacatattggttgtaaagaggacantatagctngacaaaataagggtcacatatgacaaaccctcagctaacatcttattcagtggtgaaaagttgaaaactcttcctctgagatccaaacaagacaaggatgcccactatcaccacttctttcaacacagtactgaaagttctatccagagcaattagacaagaaaaagaagaaaaaaaatccaaatttgaagaaaacagaatttaaattgtccctctttgcagatgacatgatcttatatatagaaagccctaaagacttcaacaaaaaattattagaactaatgcataaatttcaggccaggcatgatggcttatgcttgtaatctcagcactttgggaggccaaagtaggaagatcacttgactccagtggtttgag

SEQ ID NO: 40878 - DNA, 469 bp, Homo sapiens
gcagttcggcggtcccgcgggtctgtctcttgcttcaacagtgtttggacggaacagacccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgaggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtgg

SEQ ID NO: 40879 - DNA, 500 bp, Homo sapiens
  misc_feature 4, 10, 42, 302, 400: n = A,T,C or G
cgangggaanctcggccactattggccgggggagcccgagantgtcactttatttaaaaagacaaataatcctctgacaagacagcactgttgcccttactaaggagaaatagattacaatccttattcctgtacacgttagctatgttccgtatggccacaggactttcctgaaaccgtatctgtctgcttgaagtagacttgtgtttgttgagaatgaacaggcttatttgagcctccagggtggcagttcataaagacagctaagttctgaaggaaaaaaaaaatatatctttttaagnggctagagtcattattacaatcttatactgtgaaagtccaagaaatcaggcaacattgtttcctgggtcttttcagagatcttatagatttatgaagngtttttaatccatgaagaaacactaaagtgcctttctttcttcaaagcaatattatttccaagtatattaatttgttagaaaactttcccataggaaatg

SEQ ID NO: 40880 - DNA, 171 bp, Homo sapiens
  misc_feature 2, 10, 30: n = A,T,C or G
tntattggcncgggggttttgtgaggattnagtgtttagcacagtgcttggcacatagtaagccctagtaaatgttaaatcttgttacttagtgtttcgtaaaacttgagaaatagagctgagctcattcccttcctgttgattcaaaaataatacctgcatgaaaacctg

SEQ ID NO: 40881 - DNA, 313 bp, Homo sapiens
  misc_feature 11, 17, 39, 41, 50, 51, 52, 56, 61, 75, 76, 85, 110, 148,202, 231: n = A,T,C or G
cccgggaaccncggccnctccggcccgggggaaccaccncntttgagacnnntgcnccacnagtactgtttttcnnacctggttntactggaagtaatggtacctttttncttctttcttgatagaaaccctgcttacactttaaccnaagcttctacttactgccctttttctaacacagactttctttcactgtctttcntttaaaaagaaattaatgctcttaagacnatatattttaacgtagtgctgacaggacccactctttcattgaaaggtgatgaaaatcaaataaagaatctcttcacatgag

SEQ ID NO: 40882 - DNA, 469 bp, Homo sapiens
  misc_feature 4, 12, 30: n = A,T,C or G
agtnccagtaantgctcacaaattgtacantgtggaacacagaaactgtgttaatactgtgggggcagaattaaaggaggcacgtaagtacttttagactagctagacagagaaggtagtggattctccctcactggaagcattcaagtagaaattagacaactacttggtaaggtcattggtgctgagggaaaggggaaaagtagaaggttaaagcgtggaagttgaatatgaattaaatgaactcttagcattcttctaacttaagaattccaggattctatatactaatgtccctaatgtgggaagtccatttttatttatttatttttagtacaattgaaaagttattgtcctcccctgccccagatctttaatacagaaatgtagatgatggtgtaaaatctttactaaaaaatatcagtctcttacgtggagtaatttcaacagagagatgtttcctaacatg

SEQ ID NO: 40883 - DNA, 354 bp, Homo sapiens
  misc_feature 3, 10: n = A,T,C or G
aanctcggcnattatggccggagaaaccttgtggaattgcctcagcagccagctaccccactgtgtgaagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 40884 - DNA, 217 bp, Homo sapiens
  misc_feature 24, 39, 43, 52, 58, 62, 77: n = A,T,C or G
actaggacagtgtcttctcagacnaccaccaaccttganggcnacaagtgantgaggnagangtctgttttgagtantagccagagaaaacaaggatggagaaaaatctaggacagtgtcttctgagaaaccatcaggcttgaagtgtcttctcggaaaaaaccagccttgaaggctacaagtgacgagaaagattctgttttgtatatagccagag

SEQ ID NO: 40885 - DNA, 416 bp, Homo sapiens
  misc_feature 16: n = A,T,C or G
cacagcactccaaatnattgacaacaccctcacacacacacagtctctagctgaacacatgccaacagagggagaagattggtcagtcatctgaagaagggatggcagcagcctcaagcaaaaatgccacagatggctgggcatggtggctcacgcctcttatttcagcactttgggaggccgcggcagatggatcacctgaggtcgggagttcaagaccagcctggccaacatggtggggccctgcctgtactaaagatgcaaaaatagctaggcattggtggtgcatgcctgtaattccagctaccttggaaggctgggacaggagaatcgcttgaatctgggaggcggaggttgcagtgagccgagatcgtgccattgcactccagcctgggcgacgagcagaactctgtctc

SEQ ID NO: 40886 - DNA, 484 bp, Homo sapiens
  misc_feature 15, 16, 47, 434: n = A,T,C or G
gtgctcagtaaaganncagcacacagcttaatactgacctactaaantggaactaaaggtagtgttgtgtacttccgcattcacttaatcctaaattaagagtatttactgatactcagttaaaacttcatcaaatattacaaaatctagtagggacaaaaatataaaatatgtttaagttgaaggaacactcagtgtgtaggaggtgattctttttactctgttaacactggaaatgataactttatttccttatctccccatcctccacatctactaacatatattacttccagcctttagagaagtaaatgtacttaaaaagataagtatagaggcctctgctgtattgcagtgtatgcattcttgaataatctcataaaccgcaaaacctatgcagctttgtattctgcacatgaacataaatgataaanttgggaggggatagccttgaaatgctcagtgaggcatcttagtagctagt

SEQ ID NO: 40887 - DNA, 180 bp, Homo sapiens
  misc_feature 2, 3, 29: n = A,T,C or G
cnntgttaattggtttgggagcctcctangtgtgacttactgacttctctgtgttctgtgtatttgtctgaattaatgacctgggatataaagctatgctagctttcaaacaggagatgcctttcagaaatttgtatattttgcaagttgccagaccaataaaatacctggttgaaatac

SEQ ID NO: 40888 - DNA, 499 bp, Homo sapiens
  misc_feature 6, 264, 456, 463, 467: n = A,T,C or G
tcggcnatctttggccgggataaagttttttttcccttgttgcttttttctacctatttctagctactccttcttcctctatttttttttctttcgtcctatctcttggaggctttatggaaaccctggagtcagcacacaggaaaactatattgacagagaataagcaaaacacaagatctccagagatacaacatacttcacccagggatcggccaactaattcccttttttctctgcagcacattcactgtggtcactgtngtttatatagctctataaaaatactgccctgtagaaattaagcacagaggcagcactacctcctcaccctactttataggatgttgggcctaaacatatctggtttagggtaagggcaggatttttgcctgaatcctccagacttgcagacacagtaagttccccatgcacctttcagagaccataggtagnaaggggnccgngattcagaatcacaaaactacataagcccttt

SEQ ID NO: 40889 - DNA, 473 bp, Homo sapiens
atttgttctgagtgagatggaaaggcattggaggctttcgagaagaggactgacgtgatttgacttgcatttgaaaagcatcactatggctaccatggggggaaacaaagtttaaaaggcaaagaagtactcagggacctccaaggatactcatacattcctgttaggaggcaataatatgggtgaaaaatgatggtggcaaggacaagggtgataccactacttacccattacccatcagaatagtcagaaagaaaaagacaaacaaggaaggaaagaaaagacagtattggcaaggatacaggccaattagaactttcctacactgctgttggtaaggtaaattgatatgaaacaaccactgtttagaaaaccgcagtatctactaaagttgaacatctgcctcctaggcatatgcctaacagaaacgtttacctatgttcactgaaagacatatacaagattagtcatag

SEQ ID NO: 40890 - DNA, 472 bp, Homo sapiens
  misc_feature 189: n = A,T,C or G
tctactgtgtctctagggttaagccaaaagacaaaaaaaattttactacttttgagattgccccaatgtacagaattatacaattctaacgcttaaatcatgtgaaagggttgctgctgtcagccttgcccactgtgacttcaaacccaaggaggaactcttgatcaagatgcccaaccctgtgatcangaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatcctttttgtatgggaaagactatatt

SEQ ID NO: 40891 - DNA, 449 bp, Homo sapiens
  misc_feature 448: n = A,T,C or G
aaagaaaatacagttttcttctaattcggtgtctacttattttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttgttattctttaggtaagaatgattgatgttggctgatattggagtgctcattcacatgaagtggatagatacttctcaagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattatcctaanc

SEQ ID NO: 40892 - DNA, 281 bp, Homo sapiens
  misc_feature 281: n = A,T,C or G
aatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagctggcaggagtggggacagagggagagcttgtgactgggacagtgaaaataaacgattggctcttatcaatcacttgcgcan

SEQ ID NO: 40893 - DNA, 185 bp, Homo sapiens
tctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaacacat

SEQ ID NO: 40894 - DNA, 277 bp, Homo sapiens
  misc_feature 14, 19, 22: n = A,T,C or G
acaagatggtgccnccggngcnggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccacgagaattggcagaagatgacagcatattaaagtgagtgaccctgcgacccactctttggaccagcagcggatgaataaagcttcctgtgttgtgtt

SEQ ID NO: 40895 - DNA, 262 bp, Homo sapiens
  misc_feature 8: n = A,T,C or G
cgtcgttnaggtgtagaagggatagatgtagtttgctggggagcaggtgtcgtaggctgcatttctggactggtaaagatttccagtttttgaggaacaaatggtgtttcacttggagccagtgttgcccttggctgttcaagagttctagaagttttaggtgggatagaatccagaatacgatcacttgttgctgtgtaggaatctgatatctcaggctcatctgatgttgtagggcttgagaaaacatcataagttgctt

SEQ ID NO: 40896 - DNA, 240 bp, Homo sapiens
cactagagggggcataatatagcatgtgtttttatatttttaatacaaatatattttttaaaagcgctacaaaatattgttttatatatgtggtagccagcttccagatggccccagtgatccctggcctcctggtgttcatgccccagtatagccttctcctgcattttacagtgctgacttttgtaactaccaggatattgagcaaatgcagtgtgtgatttctgaggccatatcttt

SEQ ID NO: 40897 - DNA, 425 bp, Homo sapiens
  misc_feature 185: n = A,T,C or G
aagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattanctagtggagccactttctgtattgttacatggacatatgtagcaacacaagtcggaatagaatggaacctgtcccctgttggtaagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttc

SEQ ID NO: 40898 - DNA, 189 bp, Homo sapiens
  misc_feature 178: n = A,T,C or G
gaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgncaggggccaac

SEQ ID NO: 40899 - DNA, 369 bp, Homo sapiens
agcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttat

SEQ ID NO: 40900 - DNA, 315 bp, Homo sapiens
  misc_feature 2, 11: n = A,T,C or G
cnacgcttttnatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagaagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttt

SEQ ID NO: 40901 - DNA, 469 bp, Homo sapiens
  misc_feature 414: n = A,T,C or G
attggagtattaatatcctaggcagaaacatggaagtgaagacttctttctctgcaagggaaaccgatgatcccactcctgggaaatagtagggaaacttggtatgtgtatccccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacggtggtctcccacctatttgttccactgtctgccttcccctggttacttaaaattcatcagcttgtccaactggaccttctttccttcctgctgaagttnttttgaagtaaaaccttagattttgatgttaaaaacagttgtcaaatctgttggt

SEQ ID NO: 40902 - DNA, 488 bp, Homo sapiens
  misc_feature 48, 64, 68, 464: n = A,T,C or G
agcccacccgggcagccctcaccctgacaccttcgcagtaaacaagangaaaacaacttcttanaganaagcctgagcctgtaggtgtaaaagttggtgtccgaaccaggggctgtaatggcctttcttatactctagaatatacaaagacaaaaggagattctgatggaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtggngtttggattccagaagaaatgata

SEQ ID NO: 40903 - DNA, 385 bp, Homo sapiens
  misc_feature 4: n = A,T,C or G
attnaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagc

SEQ ID NO: 40904 - DNA, 470 bp, Homo sapiens
  misc_feature 34, 37, 72: n = A,T,C or G
tggatgaccttgagccctcaggtaacgagatggnggntctctggaggctgagtgccgtttgcggtgccctangaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactatttccctggctgcagccctcactcttcatggtcactggggccttggacaagttgttactgaatatgttcatggggatgccttgcagaaagctgccaaggcagggcttttggcactttcagctttaacctttgctgggctttgctatttcaactatcacgatgt

SEQ ID NO: 40905 - DNA, 407 bp, Homo sapiens
cagcttaggaagcccaaacaagcccccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatattttgcga

SEQ ID NO: 40906 - DNA, 135 bp, Homo sapiens
  misc_feature 2, 23, 26: n = A,T,C or G
angaaacataatggactcttaanaantggaaagggatgacatttacctatgtgtgctgcctcattcctggtgaagcaactgctacttgttctctatgcctctaaaatgatgctgatttctctgctaaaggcttac

SEQ ID NO: 40907 - DNA, 138 bp, Homo sapiens
ccgtggaaggaacagaaacaagcacttgggcgtgggttgtgactgcttttgggggagcctggggtttgggctcccacctgtttacagacctttttttctccttcagactttaaaattttaaaaatttaaaaaggaatt

SEQ ID NO: 40908 - DNA, 122 bp, Homo sapiens
  misc_feature 14: n = A,T,C or G
ccgggaattcggcnttacggccgggaactgcggtgatgatgtaaaaaccttcccataaaatgtaagaaaagctgatgaggctggcgacgttcagcctttgtcaataaacctgtcatgtgcgg

SEQ ID NO: 40909 - DNA, 468 bp, Homo sapiens
gataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttggagaatcatgttgaagctaaacccatatgcaaagaccatgcgccggaacaccattcttcgccaggccaggaatcacaagctccgggtggataaggcagctgctgcagcagcggcactacaagccaaatcagatgagaaggc

SEQ ID NO: 40910 - DNA, 228 bp, Homo sapiens
  misc_feature 18: n = A,T,C or G
ctattaggtaggtagatnacttgagaccggagttcaagaccagcctaggcaacatggcaaaaacccatctctgcaaaaaataacaaaaattagccaggcgtggtggcatgcgcctgtagtcccagttactcaggaggctgaggtaggacagtcgtctaagcctggggaggtcaaggctgcagtgagccactgcactacctcctaagcaacagagtgagaccctgtctc

SEQ ID NO: 40911 - DNA, 473 bp, Homo sapiens
  misc_feature 12, 20, 79: n = A,T,C or G
catttagacaanaataccgncagccttacttatgtgaagtgaaaacaggccaagctctagtttgtcctgtttgtaacgnagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaaggccaggattgatgacaaagtactcaacatcaaagaaaataaaacccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgat

SEQ ID NO: 40912 - DNA, 281 bp, Homo sapiens
agctggttccctccgagtttccctcaggatagctggcgctctcgcagaccctgtgaaattcataatggcccctaaggtaggggttgcctgacatgttcaacttggatttaacccttaaggcataagaagccgctgaaaatgttcagacgttacaaaactagggccgggcacggtggctcacggctgtaatcccagcacttcgggaggctgaggcggttggatcacctgaggtcagcagttcaagaccagcctgaccaacatggtgaagccccgtctctact

SEQ ID NO: 40913 - DNA, 337 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 40914 - DNA, 440 bp, Homo sapiens
  misc_feature 205, 344: n = A,T,C or G
actctagtatatatctggtacttttgtcgggtgggtcattatttttgaatgccttcaccatcagactgcaatctgactctgagcaagaggaccagtttgcttctccggaatggtggacaacagataggatctgaactggcagcgtcagcatcccctgggagctggctagaaatgcagaatcccagccactacccccagagcaacncgattcatgcgtctgcctttcaacaagggcatccaatgttctggaccactgaccccctcctggggtataccagctacttcattgtggggagggggcttatgagaagctctacttaggattactattttaatataaaggnaaagtagcaaaatatgttaagctttacaaacatttattttattttattttttgagatagggtccagcctgggcgacacagcaagactccgcctcag

SEQ ID NO: 40915 - DNA, 470 bp, Homo sapiens
cgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctga

SEQ ID NO: 40916 - DNA, 340 bp, Homo sapiens
  misc_feature 37: n = A,T,C or G
aaggtaaagtgttgggggcctggggcttttgaaaatnttcaacttgccatgtgacttttccagggtgacactgtgctttgaaattattgtaacatctcagtaaatatataggcctatgtcttttaccctctatatgtaataatcctgataaatgaatacagtgatataagactgtgaaggcggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaagaact

SEQ ID NO: 40917 - DNA, 299 bp, Homo sapiens
tcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgt

SEQ ID NO: 40918 - DNA, 443 bp, Homo sapiens
agaaaccaggagtagctagagccttgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaaggaaggggaagttcctcttggaaaagatatagcaaccattggggaatgaccttttcatttcagaagtggatgaggaaggtggtgtgagcatcaggtatattctggaccatttcaagtgctggtgagaagaaaggaactctttgcctgaactgggcttgggtttccaagtgctgctttggaaatgaagacccagagatgcagagcttatggtagttcataaatcttcatgttctat

SEQ ID NO: 40919 - DNA, 143 bp, Homo sapiens
gagggggcagctggacaagctcccaactgcagagtcccagccctggctggggcggggccccggcctgggactcagcatttctgatatgccttaagaattcattctgttttgtacaattattttttaaaagtaaacgtgtgggg

SEQ ID NO: 40920 - DNA, 155 bp, Homo sapiens
  misc_feature 45: n = A,T,C or G
tacagcaaggtgttcttttgttcttaatgaagaaaggctaaatgnagcactgtaatttctatactaagtatttaatccctgtcatgatgtttttgttttgtaatttgcattatttgttaaactgggaatgcaataaaacaacttttgttgaaacg

SEQ ID NO: 40921 - DNA, 312 bp, Homo sapiens
  misc_feature 20: n = A,T,C or G
aatgataatacctgcccagnatactagttatggagattaaataagtgaaggcaattattatatgttctttaaattgtgtgtcactgtactgtgcatgtattaagtgtcgttttattagcaaatatctttttgatgggtagatgtttacctgaggtggttatttaatttataggctggcttgttcacactatgttatgtaatcattgtatattaatgaatatcactattttccttaggatatgatgtttagctaattcagccatgctaggcaaaagaggtcagcattgtagaaataagcaatgtcttatacca

SEQ ID NO: 40922 - DNA, 229 bp, Homo sapiens
atagtctatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgc

SEQ ID NO: 40923 - DNA, 452 bp, Homo sapiens
caccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttg

SEQ ID NO: 40924 - DNA, 438 bp, Homo sapiens
  misc_feature 40: n = A,T,C or G
gctttccaacttggacgctgcagaatggctcccgcaaagnaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaatt

SEQ ID NO: 40925 - DNA, 407 bp, Homo sapiens
atccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttg

SEQ ID NO: 40926 - DNA, 477 bp, Homo sapiens
  misc_feature 14: n = A,T,C or G
agaattctattagnataaatttgataaattgaaatagttaaaaagaatcaagcagaaatttgggagctgaaaaatacaattggcatattgaagaatgcatcagtgtcttttactagcagaattgatcaagcagaagaaagaaatagtgagcaagctattgaaaatagggcaggcagtttgaaagtacgtagaggagacaaaagaaaaaagaaataaaaaaacaatgaagaacacttacgggatctagaaaataggtggaaaaaagcaaatctaaaagttattggccttaaagaggaggtagagaaagatataggggtagaacatttattcaaagagataataacagagaattctcaaacctagaaaaagatagtaatgtccaagtacaagaagattatacaacaccaagcagatttaacccaaagaagaccacctcaaggaatttaataatccagctcccaagaaacaaggataaag

SEQ ID NO: 40927 - DNA, 137 bp, Homo sapiens
attgaaaacacttagtatgcagttgataagaggaatttggtataattatggtgggtgattattttttatactgtatgtgccaaagctttactactgtggaaagacaactgttttaataaaagatttacattccacga

SEQ ID NO: 40928 - DNA, 460 bp, Homo sapiens
  misc_feature 27: n = A,T,C or G
gccaagttcctgcatatggaatgtatngccaggcatggaaccagcaaggatttaatcagacacagtcttctgcaccatggatgggaccaaattatggagtgcaaccgcctcaagggcaaaatggcagcatgttgctcaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccacttt

SEQ ID NO: 40929 - DNA, 109 bp, Homo sapiens
atggtttctaaaataactagcagcatcatgaccatctgggattgtctggtccctgaagtcttggttgactgaaaccagattagttgtttttcctagacttacttttcag

SEQ ID NO: 40930 - DNA, 352 bp, Homo sapiens
aagtgagaagtagttagaactacagcagtggaatcttttgcctctttttcttagccatcacaccatggaataattgttgttcctgactccttcctttaggcaattgttgtcaagacattttgggccagggctgtaatctaggaccaggaaccatcagagtttatttaagaagaagtagagacatgcggcaacctaatagttgacagcagcaaatgaaacgagaagcacgtagagcccttaggtacaactggccttacctgacctagggtaacccttcttcccactcaacttcactaatgaactttgcaggcagtgtgatggctacttattattagatgctatgtccatttat

SEQ ID NO: 40931 - DNA, 168 bp, Homo sapiens
catggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatg

SEQ ID NO: 40932 - DNA, 160 bp, Homo sapiens
atcttctggcatgtctgtgtccttctcaaagtgtggccccaagtgataaatatttgaggtgatagatatgtaaattaccccaatttaatcattatgcattgtatgcatatatcaaaatatcactctgtattccataaatatgtacaattataacatgtgc

SEQ ID NO: 40933 - DNA, 236 bp, Homo sapiens
  misc_feature 46, 168: n = A,T,C or G
tcatcggatatacagcatattccatttaggatgtgtatttaatgcntttagtaatgacgataaagtgtttttagtatgcttttagtctcttgtaactggggagaagcagtgttttttttttaggaaaggattatgcgacacaataaaataagatattctgtctgtagngaatacatttctcatgtactaacactatttataatatatgattaaagatatttcttgttttattaaat

SEQ ID NO: 40934 - DNA, 148 bp, Homo sapiens
aaggagggatcaaattatgaagggctttttctgcatcattatgtagtatagttctggagttcaggactttatcttatacacaacatataaagtcaatggaggctttgaattttacatcaagttagcattttatgaagaatactttttt

SEQ ID NO: 40935 - DNA, 131 bp, Homo sapiens
  misc_feature 23: n = A,T,C or G
caggatcaagcgtgctttccttntcgaggagcagaaaatcgttgtgaaagtgttgaaggcacaagcacagagtcagaaagctaaataaaaaaatgaaacttttttgagtaataaaaatgaaaagacgctgc

SEQ ID NO: 40936 - DNA, 192 bp, Homo sapiens
  misc_feature 191, 192: n = A,T,C or G
gagacccgcctggcaacataccaaaaccccatctctgctaaaaatagaaaaattagctgggcgtggtgccacgtgcccatagtcccagctacttgggaggctgaggcaggagaatcacttgaacccaggaggcaggagattgccatgagccaacatcatgctattgtactccagagcgagactccatcgcnn

SEQ ID NO: 40937 - DNA, 167 bp, Homo sapiens
atctaccattttctggttcttgtgttggctgtggcaggccagctgtggttttcttttgccatgacaacttctaattgccatgtacggtatgttcaaagtcaaataactcctcattgtaaacaaactgtgtaactgcccaaagcagcacttataaatcagcctaacat

SEQ ID NO: 40938 - DNA, 482 bp, Homo sapiens
gactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatct

SEQ ID NO: 40939 - DNA, 193 bp, Homo sapiens
  misc_feature 190, 191, 193: n = A,T,C or G
gttctggggcaagagaactagatttcaggtattgattgtggtctttgttcagtttctggttaactaagtcagaaaccgttactgattcttccttaaatatgttttttcttaattaaaataaacatccttcattaaactaagaataactcttaaagaccatcaattctgagtaggctccagttgcaaagcnnan

SEQ ID NO: 40940 - DNA, 465 bp, Homo sapiens
actgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcactt

SEQ ID NO: 40941 - DNA, 102 bp, Homo sapiens
agtggctttggttccagcctgagcctgctgtgaagaatgattattattgttgccagttaactgctctctccatctgtgcatcaagtgtgggaaatatttgcg

SEQ ID NO: 40942 - DNA, 475 bp, Homo sapiens
  misc_feature 7: n = A,T,C or G
agatatnaagagaatccggaagaagaaaggcgtatggcatctgttttagccaaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcct

SEQ ID NO: 40943 - DNA, 202 bp, Homo sapiens
atgatttctccagctcgcgaggaaagagtcaacggtttgggattgtgggggagagagagacggagagaaaaaggcagcgcgaagcaaagaagggaaaatatcccaaggactaatctgatcgggtcttccttcatcaggaacgaatgcaggaatttgggaactgagctgtgcaagtgcttgaagaaggagatttgtttggagg

SEQ ID NO: 40944 - DNA, 463 bp, Homo sapiens
cagagctattcatcctcgtcatatttatctgagagatagtgagggtaggactgctctcattttgtgataatggaagtttagatacagggcaccaaaactggtacctatctgggacaggaatttgcacacctaatgcaagatcactctgttctgaggctagttttctttattgagtactttgtttataggataaggaaaggcaacactttaaggatgggagaaaatccagctcaaaggctgcagttcactccttggtttaatttcatctgtgtttatttgtctgcatattgcctttgagaccaatttcctttccactgtaaatttcccttagacctgcactgtccagtaaggtggcctcatgtaactaatttcactaaaatgaagtatgtttaaaaattccattgctatattgcattagccatattttaagtactcagtagtcatgtaggtaatgtatgataca

SEQ ID NO: 40945 - DNA, 388 bp, Homo sapiens
  misc_feature 384, 385, 387: n = A,T,C or G
aggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacannanc

SEQ ID NO: 40946 - DNA, 212 bp, Homo sapiens
  misc_feature 130, 135: n = A,T,C or G
gctggctttagctcagcggttacttcgacagttctttaattgaaacaagcaacctgtctgggttgttcgagacccgcgggcgctctccagtccttttaaaaaaaaaaaaaaaaaaaaaaaaacccactanaaaanaaaaaaaaaaaaaaaaaaaaaaaaaaaaaaaaaaaaaaaaaaaaaaaaaaaaaaaaaaaaaaaaaaaaaaaaaaaaa

SEQ ID NO: 40947 - DNA, 465 bp, Homo sapiens
gactacacttcctggcatggatcttacccgtgacaaaatgtgttccatggtcaaaaaatggcagacaatgattgaagctcacgttgatgtcaagactaccgatggctacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacg

SEQ ID NO: 40948 - DNA, 470 bp, Homo sapiens
ctccgtcgtggaagcaggactgcgccgcgtcttcctcaaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaaagccacacccaagatcacctgacacccgccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaactt

SEQ ID NO: 40949 - DNA, 464 bp, Homo sapiens
  misc_feature 26: n = A,T,C or G
agaagttaggggtttgtaagcatagnaggtgctatgggaatggatgacattgtgcagaaaattggtttaggttaagaaaagtggctattgacagaaacttggagagaggccatgtatgaggtaggaagatgaactagcagaagaccttattgcctttagagagatggaagaaaatgagtggatacaacattagggaagccagaggaggtgaggagtcattagcagtcttaaaagctacaaaaattaagtaggattaaggggccaaagcactgggaatatacagaaatgatggaaactttacaagaaaaatttcagtagatagaaaaatagcagctgagctagtggttttcacgtctttttggcagtaaaaggaaagaagataaagaaatggtactctgaggagctaatggagttgagggaattatgttgcaagtattatttgaaagcagtatttaaaacttttt

SEQ ID NO: 40950 - DNA, 272 bp, Homo sapiens
attgtaattgattttagaatccttgttagtcatcaaattttattattatttttttaaactccaggatttgtgttgtattcaggtagtttccccacccccgcttcctttcctgcctctggtttaattagagaatattcatggcccagaaaagtcaaattgaagccagagtattatagaatggtcagatatataagaaactgacatagacgtaaaaggaactacatactgttgctgggcgtggtggctcacgcctgtaatcccagcagcatccc

SEQ ID NO: 40951 - DNA, 370 bp, Homo sapiens
  misc_feature 368: n = A,T,C or G
ataaatcttagaattgaaactttgtttagccaagactaatttaaagaataattgcattaaatatatttgatcagatattccagttaaaccaggcgcggtaggtggctcactcctgtaatcccaacactttgggaggccgaggcaggtggatcacttgagcccaggagttcaagaccagcctgggcaacatggtgaaaccctgtctctacaaaaaacagctgggcactgtggcgcatgcctgaagtcccagctacttggaggactgaggcgggaggattgcttgagcccaagaggtcaaggccacagtgagccgtgtttgcaccactgcactcctgcctgggtgataaagcaagaccctgtctcaaaanga

SEQ ID NO: 40952 - DNA, 115 bp, Homo sapiens
gtgtttcagtaagcatccttacaacataagtctttgtgcccatgtacagctttatcattatgaagtcttaaaagtggaattgctggattaaagggtgcctgcattttcatcttct

SEQ ID NO: 40953 - DNA, 476 bp, Homo sapiens
taactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtt

SEQ ID NO: 40954 - DNA, 471 bp, Homo sapiens
aatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgcctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggca

SEQ ID NO: 40955 - DNA, 388 bp, Homo sapiens
  misc_feature 10: n = A,T,C or G
caataacagnaatagttaaataccacaggttctttgtgttttgctttagaaaatattgctcaaggctaagagtgagttctattgatgatttttatttgctgctgggatgcaaaacaatcagaattttcgaagagtttgcttcctttttgtgcatttcctttttttaaaaaaggaggggtctgtttcagatggaaaacattggtcgctaatagcagaaacttgagaataattggtaattttcaatcctgtagaaaactagactaggtctgatgactttgacctttgttacgctcttcttccaaattttccccagccagctccctgcactcctgaccctcagcagcccattccactgagggtcgggtaacctctggaacatcacagccga

SEQ ID NO: 40956 - DNA, 286 bp, Homo sapiens
  misc_feature 6: n = A,T,C or G
aatggnatcaaactaaaaatagtaaaggcacaggaaaatttctaaataacacatttataaataattcatacgtcagtctcaaaggaaaatattaaacataaaaatgaaaatatgttattaaatatgtgggatgtagcttaaaccagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagc

SEQ ID NO: 40957 - DNA, 479 bp, Homo sapiens
ggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcacttaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaat

SEQ ID NO: 40958 - DNA, 139 bp, Homo sapiens
acagtattctacgatgcaggctgaatgtatattacagtaattctctggctaattttaaaagtaagacatagaaaacaaaacacctgtagcattttctttatttaaaattgaaactctgttttgaatcctttttattttg

SEQ ID NO: 40959 - DNA, 333 bp, Homo sapiens
tatggaaaccatttttaatataattctgcacagacacagactgctggaggctacaccagagaagggaaggaaatagaacaatactcaattcattatgaaatttatttaaagtccctgctaacttggctctcactgatgccagaaggacagcatttaatttttaaagataccaaataaaaatgcatggttacaaaactttgtagttgtctagaatacattattttgaacatttattcttaagcctctttgataatgtgtaaaattatttaaaataagacttaaaaacaggtattgacattataatagcgttcatgctaatgaaagaatttctgc

SEQ ID NO: 40960 - DNA, 372 bp, Homo sapiens
tgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacgtgaatgtaaatgtgttatatggagacacgtcttgtaaacagttgaatgtatgtaagttttctgtttgtgaaaatgtagttaatgtactcactgtggaggtcataaggaagctactttttttttaaagtggaacctaattaaaatatttccag

SEQ ID NO: 40961 - DNA, 488 bp, Homo sapiens
ctgcagtggcttcgtcttcggtttttcttttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaact

SEQ ID NO: 40962 - DNA, 364 bp, Homo sapiens
tcagcaaatcacagtaaataccccccaatatcaacattcccgtttatactcttcagtaaatttttgtaaataaaattctgggattaaaagattattctgtgacagcttttcctgaatcttattcagtaaatcacatcctttggtttttatgctttaaaacaatttcttctgaaattaccaatatttacctttgaattggactcattgaaaatagctagaaggaatgtaagcttttaaagtctgcttttgctgcaccttggtttaagggaatgagtgagaaaataacacaacacttaaatgctattccagttctaattgttaggaaaaattatctaaaatgagccaagctcattgttctcatgtt

SEQ ID NO: 40963 - DNA, 410 bp, Homo sapiens
ctaaaccccttgtttacaaaagtgaagtgggtttcttcagctcaaggcaggagctttcctgcacctggtttaattctaagaagtcggggaaatgaagccaaataaggagtcacataaacaagccatttttgcaggaagtaatatgtgtctatctctatagcagttggggaggagatgactgcattgtgaaaaacctccagactgcctgtctgcattggctgttgagaagtaaaatgctaaactgtctcttaggtaaatctctgaatcacgaaaaagttgtcagtccagaactggaggcactctggccttctgcataaacctcctacaaatatcaggttctggacaaccagcacttcttcagagatgaataatcaaaaggaattcattaagcttgactgccacaaatgttt

SEQ ID NO: 40964 - DNA, 468 bp, Homo sapiens
cattttaattaattctgttaatgtttaaatagagttttaaacccgagatttggcatgaagtctaatcgtcaaatacacaaaaggaagggtccattcttcaaaatcttttccactgaaagaccacctctgatatacaagtctcgttgcattacagggatcctgcttccaagatgcagctttcacagcttgatgattgacccagaatctcctctaatgccatttttttacacccaaaatgagatttatttcagggcttccggattttattttagctgaatacatccactcttctgtttccatttctttcaaactcttttaaataattatcttgctgcatcagcccttatataactactgtccacccaccgagaccattacatttatccgtcaattaccctatttactaataatatatcaggattcaattaagtttttttgtcttaggttgtatcctcttgcattcctcag

SEQ ID NO: 40965 - DNA, 463 bp, Homo sapiens
atccacactgcccagtgccttgagcccagtcaagttcaggagatgggatgacaccaaaagagtggtctgggaactcggaggtatcaatatcacctgggagcttcttagatatgtagactctcaggccccacctttgacccacaaaggcagaacctgcattttagcaaggacctcaagtaattcatatgcactttaatgattgacaggcactgcttcaggcagtggtttagaacactgactgcatattggaataacctggacaatttctcataaatccaagtgctgtcacccacaccaaataaatcaaaatctcagctggggggaatcctgagattctaatctataccaccacatcggtgtgaaccaccaccgcacccagaacactctgacgccacagtcaatccatatgctgtcctagacgaatgcatttagctattcagctctgcgattaacatgtcgtctt

SEQ ID NO: 40966 - DNA, 307 bp, Homo sapiens
  misc_feature 43, 201, 219, 223, 263: n = A,T,C or G
atggcgcgggagttcccgtatatgagaaaaaaattgtacatantaactgtgaaaaaccaacacttattatttgtaaacatgttaagatactaaaaaacattatgttgatgattttcacatttaattatatatatatatatatatatatatactttaaagatagagggccttgctctggatcatagctcactgcagcctcanactcctgaggcaggagantggngtgaacccaggaggcggagcttgcagtgagcggagatcgngccactgccctccagcctgtgtgacagagcgagactcctttcca

SEQ ID NO: 40967 - DNA, 245 bp, Homo sapiens
  misc_feature 7, 32: n = A,T,C or G
gattatntgtgtactcattctcttacctagcnaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactatg

SEQ ID NO: 40968 - DNA, 297 bp, Homo sapiens
  misc_feature 4, 15: n = A,T,C or G
gagnagagagaaagnatagagaagaaagaagttccaggattctaatgtaccaaagggatctcctttttcttgttttgttctgaaaatttcaccaaaagagcacaggagaacatcttggctaattcattggcgatgatgtaagaaaactgagagaaatgaaagaaatgaagaattactgctgcagataatatacagccttgaggaaagaaaggcttttaagattatagatataaaggctattgctgtattctgggataaaagaaagtctgatgcagggaaaggggaagttggaaaact

SEQ ID NO: 40969 - DNA, 242 bp, Homo sapiens
  misc_feature 241, 242: n = A,T,C or G
gtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagcnn

SEQ ID NO: 40970 - DNA, 465 bp, Homo sapiens
  misc_feature 7: n = A,T,C or G
gttgggnaagctcccagtaacttcgtaccctttgcacacaggggctacagcgcattttctacctgaaattggaagacttggtgccaccgccagcaataattgacaaacttttcctggacactttacctttctaagacctcctcccaagcacttcaaaggaactggaacgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataag

SEQ ID NO: 40971 - DNA, 450 bp, Homo sapiens
  misc_feature 378, 384, 422, 425, 429: n = A,T,C or G
gaagccttttaaatcccctctgaggtagcaagtatctatttgagaaaagaaataaaggtgcttcccttgtaaagaagcactttaatatttgcttttatgtatttatgcttcaaacaagaccaaaatattgatagtaatttttcctatgtttggaaacctgacctagattagcccaaattagtacaattactccttggtataattaccagattatactttgttgttgattaacccctccacttacatgtccatttgaaaaatgttttagcaatttaatatagcctctcacatgaagatacttttaggtattccattaggcttttcaaaggagcagttattattttagcttgtcctgttttttttttctacactattagngctatngatttccttcctatttttaagattatttcagaaattgnagngggnaatttctgtaatcccagcact

SEQ ID NO: 40972 - DNA, 337 bp, Homo sapiens
  misc_feature 33: n = A,T,C or G
tgttaaatgtggatcttttacaccacatcacantgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttc

SEQ ID NO: 40973 - DNA, 465 bp, Homo sapiens
gatttctgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacag

SEQ ID NO: 40974 - DNA, 490 bp, Homo sapiens
  misc_feature 31: n = A,T,C or G
caaagcctttgtggatcttggtataaagtcnttggaacatatctgttttaacagcaagagatcctaggcagatacttcaaaaggttaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttt

SEQ ID NO: 40975 - DNA, 448 bp, Homo sapiens
  misc_feature 7, 33: n = A,T,C or G
accactnaaaacacttttaaaaattttttaaanataaaaaatgttaaagaacatcatacaggaggtgaggaaagaatggagaagtgagcgcccagagacaggggcagggcagggagctgcttctctcccaacagcgcttgtctctccacactcacttgggctttccttccagtggcctcacagggaaatgggggcaagagttacaggtgggcaaagagttcttacacttggcaccaaaagcatgatccataaaaggaaaatttgatacactggacctcatcaaaatttcacatttttgctctgtaaaagatcctgttaacagaaagacaacattctaggagaaaatatctgcaaaccacatatccaacaaaggcctagtatctaaaatacatgaagagctcacaaaacttatggtaaaataacaaacaattcaactggaagataggcg

SEQ ID NO: 40976 - DNA, 402 bp, Homo sapiens
  misc_feature 400: n = A,T,C or G
cttgtctcaatgctcataacggatcagaaatacagattttgatagcaaagcgacgttagtcgtgagctctcgtgaggaaagtcattggctttatcctctttagagttagactgttggggtgggtataaaagatggggtctgtaaaatcttcctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagngc

SEQ ID NO: 40977 - DNA, 490 bp, Homo sapiens
aagcagcagccatgctccaaaccaccaccagtatctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaac

SEQ ID NO: 40978 - DNA, 179 bp, Homo sapiens
  misc_feature 6, 18, 22, 125: n = A,T,C or G
cttctntgtctttctttnaagnaattgaaaactcactcttttcacactaccttccctgacatcctaacttttaagcacatttttactggttcctctacttgatgggaatgtcatggtctgcttgnggaatgtgtccttgatgaaagtgttttggctctttaatctgtatgtaaatttcc

SEQ ID NO: 40979 - DNA, 237 bp, Homo sapiens
  misc_feature 29, 30: n = A,T,C or G
gatatctttgttttagatgctttaaaggnntcaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaac

SEQ ID NO: 40980 - DNA, 465 bp, Homo sapiens
  misc_feature 20: n = A,T,C or G
gttgctggctttagcagagnaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccctattcttcaactaaaagatgaggattaaga

SEQ ID NO: 40981 - DNA, 127 bp, Homo sapiens
  misc_feature 6: n = A,T,C or G
aggttnaaaaaaaatctaatgagtctgttgttcctttgcaaggcctagtgataggaacctcttcttggaaatatttgttaagccattctcacttgtagtcactcttggtaccaaatctgttgaccgt

SEQ ID NO: 40982 - DNA, 119 bp, Homo sapiens
  misc_feature 13: n = A,T,C or G
agacggacaagtnaactatgaagaattcgtacagatgatgactgcaaaacgaaggcctactttcaactcctttttcccccctctagaagaatcaaattgaatcttttacttacctctgg

SEQ ID NO: 40983 - DNA, 392 bp, Homo sapiens
tagagcattgctttttaattttaactttgttttataattatgtaaactatttacatggttccaaagtcaaatctacagaacaaaatgtattcagagtttatcttctgaccggttccctccaccctatttcctgcttctcttctgctgtaatcaaatttccccttttatccttccatttaagcaatataaacaaatgataaatgatagcatgctatttcacactttcctggacccttctattttgcttaaaatattggctgtcactccatagaaccatatagtatgttttccattgtaatgcttcattatgacagcataccattgtttattcgaccagtcactcctgattgacatttgggttgtttctagccctttgctattaaaaatattgc

SEQ ID NO: 40984 - DNA, 118 bp, Homo sapiens
ctgctgaaaatttgtctcgtttaagaggcagctagaatctttaccatatgtatgaatttgtataatttcatttttggatagggataaacttttgcttctgataaaagcctggaatttc

SEQ ID NO: 40985 - DNA, 184 bp, Homo sapiens
  misc_feature 12, 30, 32, 141: n = A,T,C or G
actggcctttgngattgcctctgaagcctntntatgccatggaggcactaacaaactctgaggtttccgaaatcagaagcgaaaaaatcagtgaataaaccatcatcttgccactaccccctcctgaagccacagcagggnttcaggttccaatcagaactgctggcaaggtgacatttccatg

SEQ ID NO: 40986 - DNA, 490 bp, Homo sapiens
  misc_feature 7, 28: n = A,T,C or G
aatatgnagaatgactcaatacccaagnaaaactcaaatacttctctgaaaactgtgagaatatacctttataaatgaagatattgcaaatttctggatggaaatgttttccaaattaatgtgttggtaatacattttgactcttaagtccaagtcagatagccagaaacttgttaatgtagttctaaagatgattggggaaaaaacatagtaatagctaggatgcttctaaaaaaaggaagtatcaatttaaattaagtacttgcatagccacatattcaagttttataaagctatggttattaaaatattacaatgctgatataaaaatcagtacagagaataaaaggcagtccaggaaataaaacccaatacggaggttcttaatcttttggaaagaagcagagctgtcacaaaatctttataaatcttgtaaaaactatggatctgtaaccgaggaaaatagtgtgcacacagtcacataaaattt

SEQ ID NO: 40987 - DNA, 316 bp, Homo sapiens
  misc_feature 32: n = A,T,C or G
aagtgccctgtggatcatcagtagtacccaantcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttca

SEQ ID NO: 40988 - DNA, 194 bp, Homo sapiens
tgagtaaaatgttaaaaataataagtgtaactcagattctggatgttcgagtttacaatacattgcctgtaataaaagctgattctgaagtgcatttttcttgacttactttggcagaaatatacttatatcttaatttatagtttgtaagtttatactgttttctaaaagtaataaatcatttcatgaaaaat

SEQ ID NO: 40989 - DNA, 465 bp, Homo sapiens
cttccttcttttttccggcgttcaagattttaagcgaggacgtggtaggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgt

SEQ ID NO: 40990 - DNA, 131 bp, Homo sapiens
  misc_feature 19, 27: n = A,T,C or G
agaagcaagtagaaacagnacccaagnaaatgtgctcaattgcaatgggccacatacctagcatctccagatgtcatttcccctctcttattttaagttatgttaagattactaaaacaataaaagctcct

SEQ ID NO: 40991 - DNA, 137 bp, Homo sapiens
  misc_feature 30: n = A,T,C or G
gctctaaatgtaaaatacactggattttanagacatggtagaaaaagaacagaaaatattttttgtattgattacatgttgaaacaatattttggctataatgggttaaatatactattaaagttgattttatctga

SEQ ID NO: 40992 - DNA, 115 bp, Homo sapiens
ctgacctagcatttatcaaggcctttcatgtggcagttaatgatatattgtcaaatattgttatctttttaaaatggtgttaggagcctgggtaacagagagaccccatctctac

SEQ ID NO: 40993 - DNA, 198 bp, Homo sapiens
  misc_feature 5, 31: n = A,T,C or G
tcttntggagatggcaagaaaggaggaaatnatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattg

SEQ ID NO: 40994 - DNA, 340 bp, Homo sapiens
  misc_feature 6, 20: n = A,T,C or G
agagcncaaaaattaatttnggcatcagtcctctatcttatattaacatattatcttattaagataaattttattaggaggctgtggcgggtggatcacctgaggtcaggagttcaagaccagcctgactaacatggtgaaaccccatctctgctaaaaatagaaaaattagccggacgtggtggcgtgtgcgtgtaatcccagctacttgggaggctgaggcaggagaatcgcttgaacctgggaggtggaggttgcggtgagccgagatcgtgccattgcgctccagcctgagcaacaagagtgaaactccatctcaaaaaaaaaaaatttttaatcg

SEQ ID NO: 40995 - DNA, 470 bp, Homo sapiens
  misc_feature 17, 47: n = A,T,C or G
tatggaccggggaaagnacctgatcttgcttcaaaaaatagaattancagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagc

SEQ ID NO: 40996 - DNA, 462 bp, Homo sapiens
  misc_feature 6, 31: n = A,T,C or G
cagganattctggatctcttttcttcagtantctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaattt

SEQ ID NO: 40997 - DNA, 468 bp, Homo sapiens
  misc_feature 13, 33: n = A,T,C or G
gtgccccgacagnattctcctatcggggtcacnttggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattaagcgcagagaccttcactgccctatcagtactaggtgtaatggtctatggaattaaaaaatatggtccctttgttgcagactttgctgataaactcaatgagcaaaaacttg

SEQ ID NO: 40998 - DNA, 472 bp, Homo sapiens
  misc_feature 34: n = A,T,C or G
agaaagccaagaaagcattatttcatcaagtccntagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattcca

SEQ ID NO: 40999 - DNA, 473 bp, Homo sapiens
  misc_feature 34: n = A,T,C or G
tacaatcgaatcctattaaaatctacataagctncccaattaccaaagaatgtctcttacatgaactataaacacgttttcaaagtacttagactatattctcatatgccaatcataaaaaagttactctttttcgtattccagaagagaaaagcaacctgctgaagccacagcagaaaaacataaattgtgaagatttcatggacatttgttagttccccaaattaatactttcataatttcttatgcctgtctttactgcaatctctgaacatgaattgtgaagatttcatgaacatttatcacttccccaatcaatactcttataatttcctatgcctgtctttaatcttttaattccgtcatctccgtaagctgaggatgtatatcgcctcaggaccctgtggtgattgcgttatctgcacaaattgtttgtaaagcatgtgtgtttgaacaatatgaaatctgagcac

SEQ ID NO: 41000 - DNA, 412 bp, Homo sapiens
  misc_feature 1, 10, 26, 27, 29, 30, 36, 39, 47: n = A,T,C or G
ncatttgtgnagctgacttgtacaanncnncctatnaanggcactanaaatacaagcaataaaataaaaaatgtaaattggacatgatcaacattttaaaacttttaaggccgggcatggtggctcatgcctgtaaatcctagcactttcggaggctgaggcaggcagatcacttgaggacaggagttcgagacaaccttggtcaacatggagaaacccgtctctactaaaagtacaaaaaattagccaagtgtggtggctcgcactttgtagtcccagctactaaggagactgagtcaggagaatcgcttggacgccagaggcgaaggttgcagtgaaccgcagactgcgtgccacttgcactctgccctgggcaacagagcaagacttggtctcaaaagaaaaacaccat

SEQ ID NO: 41001 - DNA, 192 bp, Homo sapiens
  misc_feature 7, 149, 157, 177: n = A,T,C or G
caggttntgcaaatgaatcaaagggtggtgaatatggaggattttactgagcagtggaagtcgctctcagctgaatgaagagctggaaatgggatggagtgggaaggtagtcttcccctgcagtttggccatcctggctgaactccttnctttccgnaggggtttttccctttaaanccctttttaaaattt

SEQ ID NO: 41002 - DNA, 475 bp, Homo sapiens
  misc_feature 2, 7, 29, 59, 130, 140, 180, 333, 365, 395, 434, 437: n = A,T,C or G
cncctantattttaaatatcacaaggacnttttagaatagtacctggctcaaaatattngagaaagagaaaaaggaagggattggatcaaactctggacttcatggtttcctgaattcactctgcaagtntttgggttgntttttgagacggaatctcactctgctgcccagactggagngcaatggtataatcttggctcactgcaacctccacctcccaggttcaagcaaatcccctgcctcagcctcctgagtagctgggattacaggcacgcgctggtacaccagttaatttttgtatttttagtaagagatggggtttcaccattgtnggccaggctggactcgaactcttgacctcggntccacccaccttggcctcccaaagtgctgngattacaggtgtgagccaccacacctggctgactctgcnagnatttaagtgaatgaatgtaagtccctgagaatcagaag

SEQ ID NO: 41003 - DNA, 475 bp, Homo sapiens
  misc_feature 7, 440: n = A,T,C or G
attgtgnagctagggaagaccaaccagttatgaaaaccaaattagtcacaacctatttaaatgcctatatttattcttagaagaaaatcacaccgctggatccaagagccaggagagtggtggagtaagggagcaacattcaatattaccactgagtttttactgcacatgccttcagtgctaggcagtagggctcataggatcaaagcacttctcacatgtagagagacaagtattcctgatctttagaactattttttctagtagtcatcttgtttaacatttagaattccaaacttggacagaaattttctcttaactatccacatttaaattatgttatacctttcagatgaatatacttggaattttcttaccaaaagttctgcattttaaatgaaattacccatatttgaatatgaatgtataattatccttgntggaaagacattaaaagccagcatttatttaaaag

SEQ ID NO: 41004 - DNA, 301 bp, Homo sapiens
aatcatcacacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgaggccccagctaaggttgaagccaaggaagagtcggaggagtcgggacgaggatatgggatttggtctctttgactaatcaccaaaaagcaaccaacttagccagttttatttgcaaaacaaggaaataaaggcttacttct

SEQ ID NO: 41005 - DNA, 500 bp, Homo sapiens
  misc_feature 24, 26: n = A,T,C or G
taacacttgctataaagctatagncntcaagacagtgtcatattggcaaagggatatgacacatagatcaatggagtagactagagtccaaaaatagacctacaacaaatatggtcaattgctttgatagaggtacaaagacaattcaatggagaaggagtcttttctacaatggtcttggaacaattggacatccaagggcaaatgaaacaaaacaaaacaaaaagctcaacctaaacttcatgtcttatacaaaaattgactcaaagtggatcacagatataagtgtaaaactataaagctttgataaaaacacataggagaaaatctttctgatctgaacttaggtaagttagacatgaccccaaaaagatgattcacaaaagaaaaatggatcacttagacacgtcaaaattagaaactattattctgtgaaagatactattatgagaatgaaaagataagctacataatgggagagaatacttaaaaatcacata

SEQ ID NO: 41006 - DNA, 485 bp, Homo sapiens
  misc_feature 4: n = A,T,C or G
accncttcatcgcatgaatagagaagatattctggcatttattaagtcttgcccacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgac

SEQ ID NO: 41007 - DNA, 157 bp, Homo sapiens
  misc_feature 25: n = A,T,C or G
gtaggcctttgtaaaattgacagancaggggaaaccccgtaaagtggttggttgcagttgtgtagtagttaaggactatggcaaggagtctcaggccaaggatgtcattgaagagtatttcaaatgcaagaaatgaagaaataaatctttggctcac

SEQ ID NO: 41008 - DNA, 124 bp, Homo sapiens
cattttctgaatattgataaagatatttagatgtagcagaaataatagctcctgtctatagagctgggggcggtgctaacacacaatgatacagctaaatgacaatccatgagaaaaacgagcc

SEQ ID NO: 41009 - DNA, 467 bp, Homo sapiens
  misc_feature 30, 147: n = A,T,C or G
tgcccggcacacccaaaataatgtaccttnttttcacctcaggaaactggttagtgtggtacatgtttggattttagtatagtggctaagccaaagctctgttagtaaattcctacaggagctcattggcaacttggtgcatgacangaaagagcaagactttgagccaaacagacctgggctcaaattccagctcaactacatagcagccttgtgaacttcacctctgcctcagcatcctcatctataaaattggtgatagtggcagagatttcacaggcttgttgggaggattaaaggaaatattacctactatggagcttctcgaagggaagcaattttgactttgtttttacttctttgttcaaactctcacttcagtcccaaaatgattgagttggcagcttagatattattacaggtggtttgccctacttcatgtcttttttaaacattggagcatctga

SEQ ID NO: 41010 - DNA, 467 bp, Homo sapiens
  misc_feature 33: n = A,T,C or G
gatccccgatgcgtttcctggcagctacatttntgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtg

SEQ ID NO: 41011 - DNA, 213 bp, Homo sapiens
  misc_feature 21: n = A,T,C or G
agtctcagtggagacaatagnaatcagtgatgtagtgagtagcttgagaatgcaagggaaaaaagagattaaaatggggtggggtggaaattatctttgttgacaaaaggaggtaaggattcagcctaagaacagtaagtgtacccaagcaagaaagcaggataattgaaacagataagtgtgttataaataaatacataacaaatatataac

SEQ ID NO: 41012 - DNA, 472 bp, Homo sapiens
agatatctcccatcaaatttcaaatatacacatgagaattatccacattgaaggttattagtgcattccagggacatttccatgttgattcacaactacccctttaccttacactttcctgtgttactagacgtctctttctgtaaaactcctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaac

SEQ ID NO: 41013 - DNA, 336 bp, Homo sapiens
  misc_feature 334: n = A,T,C or G
aatatattgctggattcaatttactaataaattgggtccatgttcttgagggcgattgatctgtgtgatctgtggttactttatattgtctttgtctagttctgatgttctggtaatgcttgtaacattgaggtgagaaatgtgtcttgtccaccccttcaaccccaaagacacacacattgtgtaaattagccaggcgtgttggcgcatgcctgtaatcccagctactcgggaggccgaggcgggagggtcgcgtgagcccgggaggcagaggttgcggtgagccaaggttgcaccattgcactccagcctgggcaagaagaatgaaactcgntc

SEQ ID NO: 41014 - DNA, 142 bp, Homo sapiens
  misc_feature 56, 104, 129: n = A,T,C or G
gacattcgcttctgacacaactgtgttcactatcaacctcaaacagacaccatggngcacctgactcctgaggagaagtctgccgttactgccctgtggggcanggtgaacgtggatgaagttggtggngaggccctgggca

SEQ ID NO: 41015 - DNA, 471 bp, Homo sapiens
  misc_feature 33, 60: n = A,T,C or G
gtcttccccttgtgactttttaaatattctgtnttggacattgtagttgaaattgtattngcaaaaagaatttgaggtctagtaataggtttctcattattgtttaatttgccttagagcaaattaaacaattttcatattcttatattttcatattcttatcagccgtcttttaaaaagtgcctggtcaaggatagtgaccatttaaaagttgatttgtttaactttttattattgatttgtgggagttcatcatatatcttttgtcatatacaagggggcttccaaaagttcacagaaaaatggaattaaaagataaaagtaagaagtatatggctggccatggtagctcacacctgtaatcccagcacttagggaggctgaggcaggtggattgattgagtccaggagttcaagaccagcctttgcaatatggcaaaacctcatctctacaaaaaatataaaaattag

SEQ ID NO: 41016 - DNA, 467 bp, Homo sapiens
  misc_feature 1, 10, 27, 28: n = A,T,C or G
naaatttatnagttatacagaattgtnntactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaggtcaatctagattta

SEQ ID NO: 41017 - DNA, 147 bp, Homo sapiens
gaagcactgtcagggacaggggagaggtcaaggaaggccttgttgaaaagtagtcactggatcaagcaacaaggggcattgttgaccccatgagagagttgactgggataatgcacatgatatccagattgaattaagatcagaacc

SEQ ID NO: 41018 - DNA, 112 bp, Homo sapiens
gctactcaggaggctgaggcacgagaattgcttgggcctggaaggcggaggttgcagtgagctaagaccgtgccactgcatgccagcctgggcgacaaagtgaaactgtccc

SEQ ID NO: 41019 - DNA, 482 bp, Homo sapiens
  misc_feature 2, 459, 471: n = A,T,C or G
gnatcacgattttcttccttttaaggttgatattattctgtagtacatatagaccacattttgtttacccattcattcatccatggacgcttgggttgcttccactgttttagctattgtgagtaatgctgctgtgaacatagtgtacaaatatctcttttgagactctgcttttattttattttttgcatatatacacagaagtggaattgctggatcacatggtaattctgtttttgattttttactgccatactgttttccacactagctataccactttatgtgcctacaaactgtgcacaagggttccaatttctccacatccttgccaacacttgctggttattttttttaatagtagccatcttaatgggtttgatgtggtatctaattctggtattgatttgcatttccctaatgattagtgatatcaagcatcttttcatatggttttgnatttgccttggntttaaatctac

SEQ ID NO: 41020 - DNA, 116 bp, Homo sapiens
  misc_feature 22, 34: n = A,T,C or G
aacgtacaaataaaatgacagnttgaacatactnaacccaccccattcctccccacactcatcacccttaccacgctactcctacctatctccccttttatactaataatcttatg

SEQ ID NO: 41021 - DNA, 266 bp, Homo sapiens
  misc_feature 32, 34: n = A,T,C or G
aagtaacggcagaaaagattatatgtcatacntncattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 41022 - DNA, 357 bp, Homo sapiens
  misc_feature 32: n = A,T,C or G
ataaggcagaagcttcagaaagttccgagganttgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcaggcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaat

SEQ ID NO: 41023 - DNA, 311 bp, Homo sapiens
  misc_feature 14, 27, 33, 35: n = A,T,C or G
gactgccctgaagnagggagagcgagnagagantntggagacgcacagatccccccaaggtctcccaagcctaccgtcccacagattattgtacagagccccaaaaatcgaaacagaggaaacgaacagtagttgaacatggacgaaggaattcctcatttgcaagagagacagttactggaacatagagattttataggactggactactcctctttgtatatgtgtaaacccaaaaggagcatgaaacgagacgacaccaaggatacctacaaattaccgcacagattaatagaaaagaaaagaagaga

SEQ ID NO: 41024 - DNA, 327 bp, Homo sapiens
aaaatgcaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagagggttatgatcatagctactacttcattgcaacctttattactgaccacatcagacatcatgctaaatacctgaatgcatgaaaaaactccaaataagagaatctcttcaggattataaaagttgtaaaatgcaacctgtattgctgagt

SEQ ID NO: 41025 - DNA, 203 bp, Homo sapiens
cgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgat

SEQ ID NO: 41026 - DNA, 214 bp, Homo sapiens
ggccgcggtggcgcgtgtctgtagtcctccttggcttcccaatgtcctgggattacaggtgtgagctactgtgcctggcataggttgtttttaatacagaaaaatattttaaaaaccagaagcagcccataatcctagtagccttgataactcttatttaacatttaaatttaaaatgaaataatatctttgcatctttaagaaattttcagga

SEQ ID NO: 41027 - DNA, 135 bp, Homo sapiens
  misc_feature 6, 32: n = A,T,C or G
atgtgncttcggaaacttaataatatgaatgntttttcaggataaattttaatttccagtcactcacaaattgtaaaatacaaatagttcaaaagctatagaagtatttgaaaacattgataaaataattgctcc

SEQ ID NO: 41028 - DNA, 104 bp, Homo sapiens
acccctaccatgagccctacaaacaactaacctgccactaatagttatgtcatccctcttattaatcatcatcctagccctaagtctggcctatgagtgactac

SEQ ID NO: 41029 - DNA, 227 bp, Homo sapiens
  misc_feature 4, 19, 28, 38, 48, 106, 136, 224, 225, 226: n = A,T,C or G
aacnatacttattcccaanaaaaaaaangcaagaattntttgcccggntcttcttcagattcagcatttgttctttaccagtctcattttcatcttcttccatggntccacagaagctttgtttcttgggcaagcnggaaaaattaaattgtacctattttgtatatgtgagatgtttaaataaattgtgaaaaaaatgaaataaagcatgtttggttttccannng

SEQ ID NO: 41030 - DNA, 180 bp, Homo sapiens
  misc_feature 32: n = A,T,C or G
acagactgtctatgtaacatgtagcgcacacntctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacg

SEQ ID NO: 41031 - DNA, 490 bp, Homo sapiens
  misc_feature 56, 148, 170, 428: n = A,T,C or G
cattccgccttttttatacatatatttttttcttaaatatttaaccttaggaaagnctgagaattatgcatcatttctcacagaagttgagagagtttttttttcctgttaaacagtctatttttaatgatttctctattggcatggngaggcaagccaggttaattcangaggataatgtctaatggaatgtttcagaaaattatcttctttttagtctctacttttctgaatgtataaagaacctgtgtataccgtatttcttagatttcaggttaacttgttcagaaaggccattttactgaataaatttttatttcgatgaaaatccttacttcctttgtattgggctcagagagcacactctgtctctatatgaatatggacagttagcatttgccaacatgtatctattttctcttatttgnagaaaaagctaaactaaaaagggggttataagaaggtcagcaaaggatgggtttgagatgtt

SEQ ID NO: 41032 - DNA, 498 bp, Homo sapiens
  misc_feature 2, 3, 28, 53, 61, 64, 65, 69, 79, 110: n = A,T,C or G
cnnattgcgcctctttcttctcaaacantggatgtcacaaaactatgagagcngacaacantgnngacnggtagctggnacctaggctatcttaccatgaagggtgcctngcttattgtatatttgtgtatgtagatgtaactacttttgtacaatagaggactgtaactactatttaggttgtacaggattgaaatttagttgtttcattggctgtctgaggaggtgtggacttttatatatagatctacataaaaactgctacatgacaaaaaccacacctaaagaaattttaagaatttggcacagttacctcactttgtgtaatctgaaatctagctgctgaatacgctgaagtaaatccttgttcactgaagtctttcaattgagctggttgaatactctgaaaaatgctcagttctaactaatgaaatggatttcccagtaggggtttctgcatatcacctgtatagtagttatatgcatatgtttctgtgc

SEQ ID NO: 41033 - DNA, 315 bp, Homo sapiens
atggaaactggggattactgaggttatttgcccaaggtaacacagatggtagattctggagccagagttggaaactgggtagtttgctccagacccaatgatctagcatcctagatgtggtccattagggctctctcttttcatccgtttgtaaaagagaagttttcactttcttctcaaaccattgagaaacaacttggaactggaagtgcaaagggagaattctaaagaaagcgttttaaaaaggagaaagaacaagaaagcaggacaccatttcctacctttggtattctccaaatagttggcaccaattct

SEQ ID NO: 41034 - DNA, 381 bp, Homo sapiens
  misc_feature 342, 366, 371: n = A,T,C or G
aggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggngatattcctggagtccgctttaanggtgncaaagtagcc

SEQ ID NO: 41035 - DNA, 173 bp, Homo sapiens
  misc_feature 16: n = A,T,C or G
cctctccctgacagangatgtaattcttcaatttttcaatcttaaaatttttaaattttatatttgtaaatacagtacacattttatttcttggattttgagagacattgttaattttgggggaattggcattgcgaaagacttgaaaactaatgagtaaagtctgctgaatg

SEQ ID NO: 41036 - DNA, 351 bp, Homo sapiens
  misc_feature 16, 350: n = A,T,C or G
atgaaaaatctctttnctactggtagaagcatatagtaggatatagtcaaagcgaatttagcataaaaatacatacactttatatctatgtatctatgtacacatactttttgatatgcatgtataactacatatttctgaaacgtttctaaaaataatcataaaatgattacagatatgcaaaaacagttatagagctatgtatagtttgttaacattaagataaaagccttaacattttttatgcttaaaaacattataatgcttcattatagcagaatacacatttgtcattaaaagagatatagagcagaatttctcagagttcagcagaatattcatagttgttnc

SEQ ID NO: 41037 - DNA, 315 bp, Homo sapiens
  misc_feature 15: n = A,T,C or G
gatcgatgatgagantaattgtctgaggatgctgagggactcattccagatgtcaatctgaggtccagatgtgtggccctccaataggacaaataagactctcagagcctggctctatttggggatccctcagtgacaacatagtacctctgtgagcgtgccttttctatctctccgaagagggcattagcatcctgtcttatgagtcagtatgcactttagtatggttagtgacccaagactcactttattttgttcattttgagcagagaattgtagatagatacatatatgggaaatatgttcttgattaac

SEQ ID NO: 41038 - DNA, 471 bp, Homo sapiens
  misc_feature 25: n = A,T,C or G
gaacagaatctgacagtgatgaatnagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttacctagagtcactatccggaaatctaagaatatcctctttgtcatcacaaaaccagatgtctacaagagccctgcttcagatacttacatagttttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgttagaagttaaggacatag

SEQ ID NO: 41039 - DNA, 468 bp, Homo sapiens
aagcaagaaaggcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggactatgtgttgcaagactaattggctataattatatcctatcaaagaaatcgatacgtaatagcagattgttttatattcattccattttgatggtgttatttaaattgattctctgttataagagtaaactgatgagtcgaagtct

SEQ ID NO: 41040 - DNA, 362 bp, Homo sapiens
cagtgagcatcacaaaaatgcaaatttaaatttcaatctggatggaaagttataaaattcactgcaagtaatgggtggttgggtaggtttaagaaatgccaggtgggtggatcacttgaggtctggagtttgcaactagcctggccaacatggtgaaaccttgtctctactaaaaatacaaaaattagccaggattggtggcgggtacctgtaatctcagctactcaggaggctgaggcaggagaatcgcttgaacctaggaggcagaggttgcagtgagctgagatcgtgccatcgcactccagcctgggtgacgagagcaaagctctgtctcaaaaaaagaaaagaagagaagagaaaag

SEQ ID NO: 41041 - DNA, 473 bp, Homo sapiens
  misc_feature 24: n = A,T,C or G
aacataaatgaccttttacttgcnttgtatcttatactaaaggctttagaaattacaacatatcaggttctcctactactgaagtagccttccgtgagaacacaccacgtgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcgcaaagcagggaatggttcatttactcttaatctttatgccctggagaagacctacttgaacagggcatattttttagacttctgaacatcagtatgttcgagggtac

SEQ ID NO: 41042 - DNA, 140 bp, Homo sapiens
  misc_feature 5, 6, 25, 26: n = A,T,C or G
cggcnntttattggccgggagattnntaaaatattcgagggtttgggagtcacagaccctcccctctcctcagtgcactttagcatttgcacggtgtcttccccggacagcacagcaataaatggtgtgattgcgtggat

SEQ ID NO: 41043 - DNA, 499 bp, Homo sapiens
  misc_feature 8: n = A,T,C or G
tccggctnttattggccggggctaagagtcaggaggaggagatgaagtcaggaatacagaaaagtagttaatggaagatgataaattcagcttgggacatgctgagcttgagatgtcactgggacatgcagattcagatatcatgtgctgttagaatgaaaaactgaagcccagaaatgagcacagatacatgcacttgattttgtaattgaaactatggaaaaagattttcaagggcaaacaggaaaaagtaagaaaaagaagagtagggaaaagaatgcaaaggctctaacctttgcatatgaaagatgtttgcagagaaaaaaggattcccatggtctcacaaagccaaggaaaaaaaggtccgtcgaggaaaagtcaagtaagacaaggactagcaggtagaaagcagtttcagcagtgtggagttaaaggtcaaattgccggggattaagataatgaagatgagggggcttagtggttaagagctctggagttg

SEQ ID NO: 41044 - DNA, 413 bp, Homo sapiens
  misc_feature 5: n = A,T,C or G
aaccnctggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacaagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacat

SEQ ID NO: 41045 - DNA, 489 bp, Homo sapiens
  misc_feature 2, 164: n = A,T,C or G
anacatggctctgttacgaaaaattaatcggtgctgctgttccttctgatcgtgaccctctgtgtgattctgtataagaaagttcataaggggactgtgcccaagaatgacgcagatgatgaatccgagactcctgaagaactggaagaagagattcctgtggngatttgtgctgagagggaggatgagtgccactatggctgccatcaatagcatctacagcaacactgacgccaacatcttgttctatgtagtgggactccggaatactctgactcgaatacgaaaatggattgaacattccaaactgagagaaataaactttaaaatcgtggaatccaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaagg

SEQ ID NO: 41046 - DNA, 117 bp, Homo sapiens
  misc_feature 5, 15: n = A,T,C or G
tggcngggaaagaanaatttggtataattctggtgggtgattattttttatactgtatgtgccaaagctttactactgtggaaagacaactgttttaataaaagatttacattccac

SEQ ID NO: 41047 - DNA, 494 bp, Homo sapiens
  misc_feature 5, 49, 58, 396, 437, 476: n = A,T,C or G
gaagnctcggcaattattggccgggggggaggttggctggctcttattnagtgtctgncctcaggttcattctaatgattctggcctcctcccttgactcttctaagcatattttctctgggagtgtctgagggcagccctacccaggccacaaggccaccaattactgagtcacagctccaggggagcttaagtgacctccctttgaccctggcctggacctctgtttcttcacccgttcaccaccgcctcctcctcgtccagtcctggccttcacccgaaagcccctatggttgacctttgctactggttgggaattctagtctttgtcctccttccagttgattcattataccctgtggtttgggagggcttttcagagcaagctcacaaagngggcaaaattccaacctttggctgaatggatggggacaganagaaaattagggccataaggaactgctaaatctaatgtngttcctcccttaagatat

SEQ ID NO: 41048 - DNA, 177 bp, Homo sapiens
  misc_feature 5, 13, 142: n = A,T,C or G
cgaantcttaagncggtggatcactcggctcgtgcgtcgatgaagaacgcagctagctgcgagaattaatgtgaattgcaggacacattgatcatcgacacttcgaacgcacttgcggccccgggttcctcccggggctacncctgtctgagcgtcgcttgccgatcaatcgcccct

SEQ ID NO: 41049 - DNA, 117 bp, Homo sapiens
gaaacaatttggagaagatagaagtttgaagtggaaaactggaagtacagaagtacgggaaggcgaagaaaagaatagagaagatagggaaattagaagataaaaacatacttttag

SEQ ID NO: 41050 - DNA, 259 bp, Homo sapiens
  misc_feature 12, 197: n = A,T,C or G
attggccggganggtcggagcatcagaacaagacgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgnattttctgattttataccaactgtgtggactaagatgcattaaaataaacatcagagtaacg

SEQ ID NO: 41051 - DNA, 160 bp, Homo sapiens
acggccgggcattacagctgtgttttacttttggacagaatttttatttgtatagagtgcttactaatgttaaatagttcagagtatataacatttacattaaggactcatggtaggttttagggtaaggagtttaaaggaaataagtattcaaactggg

SEQ ID NO: 41052 - DNA, 287 bp, Homo sapiens
cattactttttaaagtaaggaacaaaggtgtaatcccagcactttggggaggctgaggcaggcgggtcacgaggtcgggagttcgggaccagcctggccaatacggtggggccctgtctctactgaaagtacaaaggttagccaggcgtggtggcgggtgcctgtggtcccagctacttgggaggctgaggcgggagagttgcttgagcccgggaggtgaaggttgcggtgagtcgaggtcctgccattgcgctccagcctgggtgacagagcaagactccaacttt

SEQ ID NO: 41053 - DNA, 469 bp, Homo sapiens
aaaaactaacaaacagaaaggaatagcatcaacatcaactaaaaggatatccacaccaaaaccccatctctaggtcaccaacatcaaagaccaaaggtagtatagaaccacaaagatagggagaaaccagagcagaaaagctgaaaattctaaagaccagaggacctcttctcctacaaaggattgcagctcctcaccagcaacagaacaacgctggatggagaatgactttgatgagttgacggaagtaggcttcagaaggtcggtagtaacaaacttctccgagcgaaaggagcatgttcaaacccatctcaaggaaggtaaaaaccttgaaaaaaggttagacaaatggctaacctagaataaacagtgtaggagaacaccttaaatgacctgttggaactgagaactgtggcacgagagctttgtgacacatgcacaagcttcaatagccgattcgatcaagtgg

SEQ ID NO: 41054 - DNA, 106 bp, Homo sapiens
  misc_feature 6, 7: n = A,T,C or G
atgganngggatttctttctagttccattattaaaccctccttgaattaaccttactggagtatgccatgtttcctgctgggaccatgactgtgtttgaaactccg

SEQ ID NO: 41055 - DNA, 392 bp, Homo sapiens
atagtaatttcctatgtttttaacttaatagttttgcccataaataccaaaaggaataaaaaaggaaggactttttacaagtgttatttatttgtaggccaaatattctgcctgtcacctatcttaggatgctttttacctttctgatttctttttttctgatttgttttttcttgtgtaattgcagctttggctttacagataaagtaataaagaagagccagtgtcccattggggtctttggcaatggtttcaagtcaggctccatgcggctaggaaaggacgcccttgtcttcaccaagaatgggggtactctcactgttggacttctatcacagacctatctggaatgtgtccaggcccaggcagttattgtaccaattgttccattc

SEQ ID NO: 41056 - DNA, 488 bp, Homo sapiens
  misc_feature 66, 460: n = A,T,C or G
attgctggactagcaaaggaaaattgcactattgcacatcatattctattgtttactataaaaatnatgtgataactgattattacttctgtttctcttttggtttctgcttctctcttctctcaacccctttgtaatggtttgggggcagactcttaaatatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagnttgaagtcaaatgtcacataggcaaagc

SEQ ID NO: 41057 - DNA, 466 bp, Homo sapiens; identical to SEQ ID NO: 28984

SEQ ID NO: 41058 - DNA, 406 bp, Homo sapiens
actgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgcttggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaacatgtcg

SEQ ID NO: 41059 - DNA, 464 bp, Homo sapiens
tacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagcccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattat

SEQ ID NO: 41060 - DNA, 470 bp, Homo sapiens
  misc_feature 127, 171, 199, 403, 459: n = A,T,C or G
agggaacgtgagctgggtttagaccgtcgtgagacaggttagttttaccctactgatgatgtgttgttgccttttttttttatttattaccattatatattatattatattatatatttttggcttncttataactttggaggaaagtcaaatcttggtattattaaaatngttttaaaaaggagtaaattttccagtngataaatgaaaatcactggcctatgtttaataagtttttctttaattactggggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgngaataaaatttagctgccttgtatagtcgtttgaaagaatatgtgatctgtgaganaattatagttt

SEQ ID NO: 41061 - DNA, 468 bp, Homo sapiens
  misc_feature 10, 12, 18, 40, 101: n = A,T,C or G
gctttttcgnancgggtntgccgccaggaacacaggtgtngggaaaactacccctaaaagccaaaatgggaataggaaaagactcatatcaacattgtcgncattggacacgtagattcgggcaagtccaccactactggccgtctgatctataaatgcggtggcatcgacaaaagaaccattgaaaaatttgagaaggaggctgctgagatgggaaagggctccttcaagtatgcctgggtcttggataaactgaaagctgagcgtgaacgtgggatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccga

SEQ ID NO: 41062 - DNA, 388 bp, Homo sapiens
accaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 41063 - DNA, 107 bp, Homo sapiens
acagtatgtatattttacaatttttaaaattggaaaaagtaaaattaattactctaagttacagagaaattacctaccgataataaaagttaagtatattttcatcc

SEQ ID NO: 41064 - DNA, 471 bp, Homo sapiens
  misc_feature 26: n = A,T,C or G
gtcctccaagaatttggggcgcggantggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgaagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgactcattctcatttacttaattgaggagtaggagactaaaagaatgttcactctttgaatttcctggataagagttctggaga

SEQ ID NO: 41065 - DNA, 303 bp, Homo sapiens
  misc_feature 13, 19: n = A,T,C or G
ggcccggggaaanttgaanccctagtaacctgttaatcaccctttaaaaagtaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctg

SEQ ID NO: 41066 - DNA, 472 bp, Homo sapiens
  misc_feature 11, 20, 21, 66: n = A,T,C or G
agcatttggantaccttgtnnttctctactcttacaaataacacctgaagcaagaatgaccaatanttctgataattggcactggatcacaaaatgtgataaaactttaaatgtataaaactttatcaaataaagttttattttcccctttaaaatgtatttctttagaggcattactttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatatttctatgggctgtttgtaatttctctttttttccttttttattttggtgctgaatatgtccttgtaggctctgttttaagaaaacaatatgtgggaaatgatttaaatttttcctattgctcttccttgtggaaaat

SEQ ID NO: 41067 - DNA, 467 bp, Homo sapiens
  misc_feature 368: n = A,T,C or G
agtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggngtgtttcgtgggaacaactgggcctgggatggggcttcactgctgtgacttcctcctgccaggggatttggggctttcttgaaagacagtccaagccct

SEQ ID NO: 41068 - DNA, 473 bp, Homo sapiens
cattgagacagcataggcctgtgaagcctgacaaacttgaattcagatattgtttcaacagttcatatctgtgtccttgatcacttcataagcctcagtttcctcctctataaaatcagaaaaataattgctactttacatggttgttagagataacgagtatgaagtacctcacactgagcctgtatatagttgatcctcagtaaaacagttatcattataagtaaaatgaggttgagaatgttgctctgttatactgatctccaaatggggctaaaacaatttgcataatctgattcctctatctgtccatgcgtatatatttatatcaggtgtggacagacttttccactctgcaatatattacttaaatatatatcagaaaagtttgcctatcttattattcctaatcttctgaaaaaaaaattcacaataaaagagtactatttttaaggctttgtccattatactta

SEQ ID NO: 41069 - DNA, 500 bp, Homo sapiens
  misc_feature 6, 9: n = A,T,C or G
tctcgnctntttatggagcgggtcctctctgcccctaaaacagtaaatatgatcatgttattctcctacttacatgcccgtcagtggctccccagtgccgtactgctgtggcacacagaaccctacgtgatctggtcctgcgtgctctgtaagtggcaagtcccagggcctcttcgtgcaggctgttcaagggggtctcataacctaccagtccgagttagacttgttgagtcttaaaaccaagctgctttgagttgggtcttcagatgaactgggaatcaacatatttgggatggatctgtagggtgcatttaaaaggcactgaatgtttggaatggagtgcaagaattaatgttaagttaccaggagaaaattgaggtattaagggatctgcgcatatagttttcaaaaatcaattaaacaaaaagcctgttttttaactgattctatagttcatttggaagactatgtatattacattatatcatatatctacatgt

SEQ ID NO: 41070 - DNA, 460 bp, Homo sapiens
ctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacaggagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccaga

SEQ ID NO: 41071 - DNA, 286 bp, Homo sapiens
  misc_feature 285: n = A,T,C or G
cacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaanc

SEQ ID NO: 41072 - DNA, 130 bp, Homo sapiens
gaaaacacttagtatgcagttgataagaggaatttggtataattatggtgggtgattattttttatactgtatgtgccaaagctttactactgtggaaagacaactgttttaataaaagatttacattac

SEQ ID NO: 41073 - DNA, 226 bp, Homo sapiens
agatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatg

SEQ ID NO: 41074 - DNA, 465 bp, Homo sapiens
  misc_feature 12, 13, 109: n = A,T,C or G
gaaatttcggcnntttatggcccggggctttccaacttggacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtgggatgagaactaatcgctgatcgtcagatcaaataaagttataaaattg

SEQ ID NO: 41075 - DNA, 461 bp, Homo sapiens
agtaggattgcatctgaaaggggttagtggacctgtatgcggattcagatcaactggtgttggaagttatgtagagatgtcatggcatccataagcgcagggccttgtgatgctcaaaaacatacttggattggatcagtgttgtttgtcacaaaaaaggcaacttgttctttgagaagcctcattttttattttttaaatgttgatttttttatgagtagttgctgtgtgggatctggatataaagattaaattctcatcagagagggagtgagtgatacattatgttctttgctgaaagaccatgtgtctcggaggctgaagcaaaggaaataaacacactctcctggtgtttatgggggtttcctcattgttccctgatataattcagtttaagagttggtgacagaagcagatgccctatattcatgggatgttccatctcacttcatgacttactg

SEQ ID NO: 41076 - DNA, 123 bp, Homo sapiens
caggcatgctcataaggaaaggttaaaaaaagtaaaaggaactcggcaaatcttaccccgcctgtttaccaaaaacatcacctctagcatcaccagtattagaggcaccgcctgcccagtgac

SEQ ID NO: 41077 - DNA, 402 bp, Homo sapiens
  misc_feature 2, 16, 87: n = A,T,C or G
cngttttgcagacgcnccgccgaggaaaaccgtgtactattagccatggtcaaccccaccgtgttcttcgacattgccgtcgacggngagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagact

SEQ ID NO: 41078 - DNA, 220 bp, Homo sapiens; identical to SEQ ID NO: 38012
  misc_feature 218: n = A,T,C or G

SEQ ID NO: 41079 - DNA, 442 bp, Homo sapiens
  misc_feature 37: n = A,T,C or G
attgtgtactttcttcaatgccggcactcttctaacnctttatatgtattagctcatcagactcagcctgataatatgggatgagtcctgtcattatccacatattagataacaaatctgagacatagaaaagtaatctgccttaggtcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtaatccgagtgctttgggaggccaaggcaggaggactgcttgggccgggagtttgagaccagcctggacaacggagtgagattcatctctac

SEQ ID NO: 41080 - DNA, 325 bp, Homo sapiens
catgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttac

SEQ ID NO: 41081 - DNA, 472 bp, Homo sapiens
  misc_feature 327, 374: n = A,T,C or G
cgcataaacagaaccaatgacaaaaaccacatgattatctcaatagatgcagaaaaggccttcaataaaattcaacaccctttcatgctaaaaacactcaataaactaggtattgatggaacatatctcaagataataagagctatttatgacagacccacagccaatatcatactgaatgggtaaaagctggaagcattccctttgaaaactggcacaaaaccaggatgccctctttcaccactcctattcgacatagtatttgaaagttctggccagggcaatcaggcaagagataaaaataaaggatattcatccaggaagagnaggaagtcaaattgtctctgtttgcaaatgacatgattgtatatttnagaaaaccctgtcgtctcagccaaaatctccttaagctgataagcaacttcagcaaagcctcaggatacaaaatcaatgtgcaaaaatcacaagcatt

SEQ ID NO: 41082 - DNA, 209 bp, Homo sapiens
acaaggcaaaatagaaaagaatgatctaaaaattattatgaagaagataatacatatgaaaaagaaaatagatataaattagtgttcctgaaaaaagagaacagaacaaatggattaaagacaatattaagatatttataaataaaagggaaaattttctggttgtaccactttattctagcctgggaaacagagcaagaccctatccc

SEQ ID NO: 41083 - DNA, 381 bp, Homo sapiens
  misc_feature 192, 215, 351: n = A,T,C or G
gacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccggggttgattatttttattgcttcaaaagcagnggactgtcttttggattcaaagngggcaaaggccaagaaaggagaggaagctttatttacaaccagggagtctgtggttgactactgcaacaggcttttaaagaagcagttttttcaccgagccctaaaagtaatgaaaatgaaatatggataaagacntaaagaaaggaaaaagataaagggaaaagc

SEQ ID NO: 41084 - DNA, 110 bp, Homo sapiens
  misc_feature 65, 70: n = A,T,C or G
tacggtggctcacacctgtaatctcagcactttgggaggccgaggtgggcggatcacctgaggcnagganttcaagactagcctgggcaatacagtgagacctcgtctct

SEQ ID NO: 41085 - DNA, 461 bp, Homo sapiens
acaactcggtggcggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaaga

SEQ ID NO: 41086 - DNA, 471 bp, Homo sapiens
gattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagaattctttcccctgctgagttggaaattccagtgcagcactgattggccacagttg

SEQ ID NO: 41087 - DNA, 461 bp, Homo sapiens
  misc_feature 461: n = A,T,C or G
gctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagagggaggaagacgaggattaaatttcatttatctggaaaattttgtatgagttcttgaataaaacttgggan

SEQ ID NO: 41088 - DNA, 470 bp, Homo sapiens
  misc_feature 10: n = A,T,C or G
agtttttatnagacttaagtttaactgcagatgggtttattggtcactacctattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggggtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaaagatgggcgaggcaaaatcatgccaaacagctttatcattgatgttcaagaccaagaatcaga

SEQ ID NO: 41089 - DNA, 376 bp, Homo sapiens
aagatacgtcatttctgtattggcaaaatgccctattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcactttttaaaactttccaagctagctacttattttcattttcagggttgagtactctaagctctctacttactgtgagaagttttctacattgtaaaattaaaagattatatttaaaatacttctttaggatgttattcagccatcaaaaaaaaaaccaactaaaatgtcttaccagtaaagtattattaaaagc

SEQ ID NO: 41090 - DNA, 358 bp, Homo sapiens
  misc_feature 277: n = A,T,C or G
cagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaaganaattacttccccactgatggagcccagcagcattgagaaaattgtaagagattgatgctcacataggttgtgccatgagtg

SEQ ID NO: 41091 - DNA, 473 bp, Homo sapiens
gtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatatttgtatttggtattataagaaatctagagatgatttaaattatacaggaaggtgtgcgtaggttaccgtgcaaacgctatgccattgcccatcagggacttgagcatcctcagatgtcggtgtctgagggttgaggttgcagtcctggaacccatcccccatggatactgaggcatagctgactgtgtgttttcactttgctttcagaactacgac

SEQ ID NO: 41092 - DNA, 324 bp, Homo sapiens
caggattaataattcttcttttaaaaatactaatgtccatgtatgttgaatgaatgtaaactactttctgctgcttccaccagttgagatgaatgctcatggaagttataggtttcttcccaaattggctaattctattgtacttgtaatgtgtttatattattctactaagtattacgtaaaccaatgataaatgaatgtgaaaagagaactgtttaaacgcaaactaagttaaatgctttggaaaacttgataaaggcaaattaattgctgaagaaaattgtagtcagtttaggtgtgggcaagatgactaaaagattacag

SEQ ID NO: 41093 - DNA, 299 bp, Homo sapiens
aagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactc

SEQ ID NO: 41094 - DNA, 145 bp, Homo sapiens
gaacactgtaggctttaaaagtctagaatttttactcaggaggctgagacaggagaattgtttgaacccgggaggtggaggttgtggtgagccgggattgcatcattgcactctagcctgggcaacaagagctaaactccatgtc

SEQ ID NO: 41095 - DNA, 471 bp, Homo sapiens
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggatttgtagagccatatattgcttggggggtaccccaatctgaagtca

SEQ ID NO: 41096 - DNA, 357 bp, Homo sapiens
aactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtattgtttgtggtataggaatgtcatggtaaattgtttttcaataaatattttgaaacatc

SEQ ID NO: 41097 - DNA, 278 bp, Homo sapiens
  misc_feature 32, 165: n = A,T,C or G
gttcagcaaatccgtcttccgcaattactggncttccaccaaatccagatcttccaggaaaatccacgtcttccaggaaatccatgtcttccaataatttcaaggtcttccatcaaatacagatcttccagctaatccatgtcttccagaaaaatctgtgtcttncaccaaatccaagtcttccagtaaatctagttcttccagaaaaatctagatcttccagtcaatcagtgtcttccagaaagaaatccaggtcttccagtcaatcagtgtcttgc

SEQ ID NO: 41098 - DNA, 471 bp, Homo sapiens
actccaagcacgtgaattactccttggtattgagataagcatttctgaagattcttctatttctacaagccagtagctctttgaacggacttttattgtcatttatctaagtggcctaaaataatgaataaactgctgaaagagtttgccctattcccaggaattatttcacacactgaaagaatctgtgacttagaccactttctttcaaggggactcagagagttatggaagcaaaacacgattttaatgtccccttggtaacaaggacttttgaacttagtatcctacatcatagatagttttcttttccttgaatttcctggattttttttctttctataatgttgttgattgttatcttaggtgccattttgcttttttcttttgtccaattgttctacatgtaaaaataacaattataaatgaacctgcttgtaactgctgggcagtcaggtttgtaacacctat

SEQ ID NO: 41099 - DNA, 471 bp, Homo sapiens
  misc_feature 36, 37, 58: n = A,T,C or G
aacaatacattgagcagagccaggcagaaatttatnntaaccggtttgatgctgtgcnctcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttct

SEQ ID NO: 41100 - DNA, 469 bp, Homo sapiens
  misc_feature 332: n = A,T,C or G
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaacggaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggnaagaagaggagacttcaaatgaaggagaaaacaatgaagaatcgaatgaagatgaagactctgaggctgagaataccacactttctgctacaacactgggctatggagaggacgccacgcctggcacagggtataca

SEQ ID NO: 41101 - DNA, 322 bp, Homo sapiens
  misc_feature 9, 18, 43, 44, 318: n = A,T,C or G
tgtaagaangcccttaantaaagaaggtaagaaacctaggacnnaagccccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctganaaac

SEQ ID NO: 41102 - DNA, 329 bp, Homo sapiens
  misc_feature 236: n = A,T,C or G
gttgcccaggctggagtgcaaatggcttgatcttggttcactgcaacctctgcctcccaggttcaagcaattctcttgcctcagcctcccgagtagctgggactgaaggcgtgtgccaccatgcccagctaattcttgtatttttagtagagacggagtttctccatgttggccagactggtctcaaactcctgacctcaggtgatctgaccgccttggcctccgaaagtgctganattacagttgcgagccactgtgcgtggccagaactttataataagagacttgaagctgggtgtgacggggcacgcctctggtcccaacctact

SEQ ID NO: 41103 - DNA, 277 bp, Homo sapiens
caatatagcatataaatattatgccctcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggcttgttttgttttattttttaatgaagtaaacctatattcctgat

SEQ ID NO: 41104 - DNA, 470 bp, Homo sapiens
tacctccgctaccataattatcgctatccccaccggcgtcaaagtatttagctgactcgccacactccacggaagcaatatgaaatgatctgctgcagtgctctgagccctaggattcatctttcttttcaccgtagggggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctc

SEQ ID NO: 41105 - DNA, 162 bp, Homo sapiens
gtacccacaaatggtgatatactttgtttctactgaaaaatgtattgtgctttgatactaaaaatctgtaaaatgttagttttggtaattttttttctgctggtggatttacatattaaattttttctgctggtggataaacattaaaattaatcatgttcc

SEQ ID NO: 41106 - DNA, 418 bp, Homo sapiens
  misc_feature 15, 16, 21, 23, 33: n = A,T,C or G
accagtagggttgannagagncnctaaggaaanttagaagtacctgtactttttgctcttggaaatgaaatacttgtttcctgcacctttgaaaaaaataacaggattttacagccttctgatgattccttcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttg

SEQ ID NO: 41107 - DNA, 498 bp, Homo sapiens
  misc_feature 9, 16: n = A,T,C or G
cccgggaanctcggcnactttggccgggcagtaaaggaggtggggtagagaattcaatcgtgggctatctctccagagatgtgtttacaggtgtgtataaagagtgctggcagactcaaggaggacacatgtgactgtgctggtggttagaattatgatcttggataaaatgaaactgcatagatattcaagtgaggctttgtaaactacagagataaagaagccatgccagtttaagagcattagagaaatccctcagcttggcctagaaaatgtccctcgataagagaaacagacggatctagctgaccagctgccagctttcacttcttacggccacgctgagttagctggaatcatcttagcattgcaagatagatggctctaccttgtggtagtccaagctggagggtggtaagtagtcagagcagctaatataataccatctttaggcttacagtttgatccataatttcccttccataatttattttaatt

SEQ ID NO: 41108 - DNA, 103 bp, Homo sapiens
  misc_feature 1, 12, 17, 22, 23, 47, 65, 78: n = A,T,C or G
natttagaagcntgccnagaannagacctggtgaaaaagtaaacccntttcacctacaaaatttnaccctgcaaaccnttaaaaccctgcaaaattttccttt

SEQ ID NO: 41109 - DNA, 121 bp, Homo sapiens
  misc_feature 6, 11, 15, 19, 50, 120: n = A,T,C or G
aaaganaaacnaatnaacntgacaaagaagttgacctgaacatgtaaccnctgccctaccctgttaccttgcttagctgcaaaataaacttgttgctgacctgctgtgctcgcagtagana

SEQ ID NO: 41110 - DNA, 347 bp, Homo sapiens
  misc_feature 15: n = A,T,C or G
ctctcttaagaagangatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactg

SEQ ID NO: 41111 - DNA, 325 bp, Homo sapiens
  misc_feature 14, 23, 24: n = A,T,C or G
cagggtgttgaccntttttagcnnttgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctg

SEQ ID NO: 41112 - DNA, 461 bp, Homo sapiens
gctaaacctagccccaaacccactccaccttactaccagacaaccttagccaaaccatttacccaaataaagtataggcgatagaaattgaaacctggcgcaatagatatagtaccacaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttatagggtaggaggcgacaaacctaccgagcctggtgatagcttggttgtccaagatagaatcttagttcaactttaaatttgcccacagaaccctctaaatcccttgtaaatttaactgttagtccaaagaggaacagctctttggacactagg

SEQ ID NO: 41113 - DNA, 471 bp, Homo sapiens
  misc_feature 1, 11, 94, 124, 127, 187, 241, 272, 309, 318, 370: n = A,T,C or G
nattgtacagnctttggggtgtgatatgctatttgtctttccaaggaggcagtcttcaaagaaaaaaaaaaagacaaagcagcctatactcagngttaagaattgctgcttacttttgatgttnggncaagagctggcactgctagagatgttctgccttttgaggcacagctcatgccatccatgngagcacagagtctcatcagcattcacatcttacctgctactggtctcacactgnggaaatgggtaatagaaacagaaacatcagngacattttgggctcttttattcagaggaatcaaaagngacaaaganaagccagggtcagcagtaggcagtaggtccacccattgggatagcatagctnttggggaaattgtcagcacagaggcaaaaccatggtatttcccgtgactgcagcaggaggtctgcagttgtgactttagccaagaagcattgggaatccaa

SEQ ID NO: 41114 - DNA, 468 bp, Homo sapiens
  misc_feature 3, 10, 12, 16, 18, 20, 22, 25, 29, 33, 36, 40, 45, 65, 67,68, 74, 76, 93, 183, 184: n = A,T,C or G
aangtaacgngnccanantnanganctangaanacnagcnaggcngaagtgcacatgagagacananngtacgngntctcaaccaagaaccanccagatgacatgtttttctgtgtggcaacctgcccttaaattgtcagatcttaactatcttgtgtttgctgtgcttgcagccataagctnncctccttttttgcttatcccctggctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccat

SEQ ID NO: 41115 - DNA, 322 bp, Homo sapiens
  misc_feature 2, 21, 35, 57: n = A,T,C or G
cnccccccgggaatctcggcntctttggccggggnagttaatcacccacctagggcntgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattggtgttgtgcagcattaaaaaaaatcaaaataaaaattaaatgtgaac

SEQ ID NO: 41116 - DNA, 140 bp, Homo sapiens
  misc_feature 77: n = A,T,C or G
gatgaccagatttgatctcagcctgatgaccctacaggtcgtgctatgatatggagtcctcatgggtaaagcaggangagagtgggaaagagaaccaccccactctgtcttcatatttgcatttcatgtttaacctccgg

SEQ ID NO: 41117 - DNA, 473 bp, Homo sapiens
caaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaaca

SEQ ID NO: 41118 - DNA, 470 bp, Homo sapiens
  misc_feature 109: n = A,T,C or G
cagatgactggcctttacagtaagagtaaaaggaggtcagagtagaaggatgtcagatcatgtaggatttgtaggcccctttgagaactttagattttattattctgcntgagattggaaaccactggagttctgaggcaaagaacatataatttggtttactttctaaagcaattgctctgagagcttaaaaaaagaataaaatttaggaaggcaaaaggggaagcaggaataataatcagggcaacttcaatcatttggaaggaaacaatggtgacttggacaaggttgtcggagtagaggtggagagaactagattaagtgtacattttgaaggctgagctagcaagatttgttgttgattatgtagagagcataagagaattggagctcaaggataatgacaatgtatatagcctgagcatctgaaatgattggcatgcaatttactgagatggggaagacaagac

SEQ ID NO: 41119 - DNA, 140 bp, Homo sapiens
gagacaacttcccaagccaaagcagtttttccccctaggggtgggaggaagcaaaagactctgtacctattttgtatgtgtataataatttgagatgtttttaattattttgattgctggaataaagcatgtggaaatga

SEQ ID NO: 41120 - DNA, 322 bp, Homo sapiens
accaagaggacaccacggtgaaagaagagcaccaactgtgcctatgacaggattgtgcttagaggacaagaaatcgtcagttctgttgttcccaagtcaaacagtgatttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacata

SEQ ID NO: 41121 - DNA, 464 bp, Homo sapiens
ctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcagga

SEQ ID NO: 41122 - DNA, 465 bp, Homo sapiens
  misc_feature 210, 421, 425: n = A,T,C or G
ctcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtntctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtgaaggtnagtntaaataaacaagaaaaacttcttcggaaggcatggcgaag

SEQ ID NO: 41123 - DNA, 470 bp, Homo sapiens
  misc_feature 25: n = A,T,C or G
aattacatcttgatggcacaaaatngcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtaccttggtgggcttggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaat

SEQ ID NO: 41124 - DNA, 355 bp, Homo sapiens
  misc_feature 11, 40, 58: n = A,T,C or G
taacccgagantacaccatcaacattcacaagcgcatccntggagtgggcttcaagangcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgagggatgaagattcaccaaataagctatatactttggttacctatgtacctgttaccactttcaaaaatctacagacagccaatgtggatgagaactaatcgctgatcgtcagatcaaataaagttataaaattgc

SEQ ID NO: 41125 - DNA, 177 bp, Homo sapiens
  misc_feature 54: n = A,T,C or G
caacactggtgtacatatgtccgctgggtgagttgacctgtggcctcgcacagngattctgggccctttatgcttgctgtctctcagaattgttttcttaccttttaatgtaatgacgagtgtgcttcagtttgtttagcaaaaccactctcttgaatcacgttaacttttgagatt

SEQ ID NO: 41126 - DNA, 288 bp, Homo sapiens
  misc_feature 1, 8, 25, 58, 59, 79, 113, 177, 187, 234, 254, 270: n = A,T,C or G
nttatggnccgggggcttttgctgngtctactgcgagaatgaagtactattctcagcnntcagactgtcgacattccangaaaatgtcgaccttactctgaagggacgcacanttatcgtgaagggccccagaggaaccctgcggagggacttcaatcacatcaatgtagaactcanccttcttggnaagaaaaaaaagaggctccgggggtgacaacatgggggggtaacacnaaaggaactggctacccgtncggactatttgtaggncatgtacagaacatgatc

SEQ ID NO: 41127 - DNA, 469 bp, Homo sapiens
ctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctctcaacacaagcgagatgaagaaactgatcacccacatgggggagatggaccacccctggaactgtccccatggaaggccaaccatgagacacatcgccaacctggctgtcatttctcagaactgaccgtagtcactgtatggaataatttgggttttatcgcagatttttatggtttttgaaagacagagtcttcactaaccttttttgttttaaaatgaacctgctactt

SEQ ID NO: 41128 - DNA, 468 bp, Homo sapiens
cttttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctcccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagacccaggtgttgcttgttcagtatctcaagcccagaaagatgaattaatccttgaagg

SEQ ID NO: 41129 - DNA, 161 bp, Homo sapiens
tgcccagtgctctgaatgtcaaagtgaagaaattaatgaagcgcgggtaaacggcgggagtaactatgactctcttaaggtagccaaatgcctcgtcatctaattagtgacgcgcatgaatggatgaacgagattcccactgtccctacctactatccagc

SEQ ID NO: 41130 - DNA, 467 bp, Homo sapiens
tcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagc

SEQ ID NO: 41131 - DNA, 389 bp, Homo sapiens
  misc_feature 384, 388: n = A,T,C or G
caagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggncctnt

SEQ ID NO: 41132 - DNA, 346 bp, Homo sapiens
aagagaataaccgaaaaattgccgaagcacaagccaaactggccgaagaacagttgagaattgttgaagaacaaagaaagattcatgaggaaaggatgaaactagaacaagaacgacaacgtccacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgttttttttaatttgtaaaatctggaaagttagcttgttctaataggggctat

SEQ ID NO: 41133 - DNA, 176 bp, Homo sapiens
catgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaat

SEQ ID NO: 41134 - DNA, 456 bp, Homo sapiens
gagatgaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaac

SEQ ID NO: 41135 - DNA, 266 bp, Homo sapiens
  misc_feature 35, 38, 51, 52, 62, 65: n = A,T,C or G
acgattaacagctccaatcttcttaaataaagctntgntttcctatatttnnatgaactgcnganaccccacagggaccaggtatttgtattcaaattacatttcatggtttcccattgtttcacaatgagttctaataaatgggatttactataataatccaagtatgacattagcccggtatgctttcatgaatgtttttatgtagattttcctcccatgaacatgagtaaataaatctgtttcctgaatggattgtggttgca

SEQ ID NO: 41136 - DNA, 261 bp, Homo sapiens
  misc_feature 259, 261: n = A,T,C or G
caccaatcccaagcaagcctagacttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcggcgnan

SEQ ID NO: 41137 - DNA, 293 bp, Homo sapiens
  misc_feature 33: n = A,T,C or G
cttgacacaaatgagattaaaccacaacagatnaaaacctgtagaatacaacaaaagcaatactaaagtggaagtttatagcaacaaatacctacagcaaaaaaagtagaagtatttcaaataaacaattttatgatgtccctaaaagaactagaagagtgagaatacataaaacctaaaattatcaaaaggaaagaaactgtaaagatcagaacagacctaaatgaaatatagactagaaaacagtacaaagcatcaaggaaatgagaagttggttctttgaaaatataaga

SEQ ID NO: 41138 - DNA, 225 bp, Homo sapiens
  misc_feature 124, 139, 219: n = A,T,C or G
gaggcattgaggcagccagcgcaggggcttctgctgagggggcaggcggagcttgaggaaaccgcagataagtttttttctctttgaaagatagagattaatacaactacttaaaaaatatagncaataggttactaanatattgcttagcgttaagtttttaacgtaattttaatagcttaagattttaagagaaaatatgaagacttagaagagtancttggg

SEQ ID NO: 41139 - DNA, 472 bp, Homo sapiens
  misc_feature 2, 29, 38, 54, 57, 211: n = A,T,C or G
gnccaagaacttgactgtaactggaacanaacctggtnaggtgagcagtaggtnatncagtcccagtgtcagaatgattactacctcaggaccaacctcagaaaagccaactcgaagtcatccatggacccctgatgattccacagataccaatggatcagataactccatcccaatggcttatcttacactggatcaccaactacaggcnctctagcaccgtgcccaaactccaaagaatctatggcagtgtttgaacagcattgtaaaatggcacaagaatatattgaaagttcaaacagaaattgcattgttattacaggagaaagcaagaactagttgcagaactggaccaggatgaaaaggaccagcaaaatacatctcgcctggtacaggaacataaaaagcttttagatgaaaacaaaagcctttctacttactaccagcaatacaaaaaacaactagaggtcat

SEQ ID NO: 41140 - DNA, 347 bp, Homo sapiens
gctttttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggaga

SEQ ID NO: 41141 - DNA, 368 bp, Homo sapiens
  misc_feature 5, 12, 23, 32: n = A,T,C or G
aaacnaaacagnactttataccnacaataatnaaaacaaagaagagcattacataatagtaaagggttcaattcaacaagaagatctaactatccgaaatatacatgcacccaatacaggagcacccagattcatagggcaagttctcagaaagctttacaccagtcagaatggtggatcatgaggtcaagagatcgagaccatcctggtcaacacggtgaaaccccgtctctactaaaaagacaaaaattagctgggcgtggtagccgtgtgccttgtagtcccagctactcaggaggctgaggttggagtgagccgaaatcgtgccaccgcactgcagcctggcaacagagcaagactccatccca

SEQ ID NO: 41142 - DNA, 379 bp, Homo sapiens
agatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtaggaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtaggagagag

SEQ ID NO: 41143 - DNA, 235 bp, Homo sapiens
  misc_feature 233: n = A,T,C or G
tatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaangt

SEQ ID NO: 41144 - DNA, 288 bp, Homo sapiens
gaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcatt

SEQ ID NO: 41145 - DNA, 296 bp, Homo sapiens
gaacagctaaaagagccacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 41146 - DNA, 468 bp, Homo sapiens
  misc_feature 190, 215, 333, 441, 449: n = A,T,C or G
caattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggnggctattctgagatgactattcagnggctaacttgggttaggaagaaaataattaggtattttctccaaatgttcactggtactctgccactttatttctctcatctgttacacaaagaaccaccaggaaagcaaatcagttnggttggtaactctgtaattcctaactatcactggtttggttctggactaaaactacattgacagattgaatttgcctaatatgatgactgtttttaatatggatctgnatggggtnctattcagcacaaggaaat

SEQ ID NO: 41147 - DNA, 337 bp, Homo sapiens
aggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttagaagatagaaaaatataaag

SEQ ID NO: 41148 - DNA, 194 bp, Homo sapiens
  misc_feature 37: n = A,T,C or G
gtataacattctcaggatttgtaacacttaaatgatnagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattctt

SEQ ID NO: 41149 - DNA, 313 bp, Homo sapiens
agggtgagtgtttccactcaaaatatgtcaacttaaaaaaaaataggccctttcataaaaaccaaactctagcaagatgcaaatgcctggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgtc

SEQ ID NO: 41150 - DNA, 153 bp, Homo sapiens
aaataataagggttgagggggagaataaagctactgaaatatggaaagaagactaacactacttttaaactgatgttctactaatgtagacccgtacatcatatcaccattacattgtttaagcattaaagtttgcactgtaagtggctcttc

SEQ ID NO: 41151 - DNA, 410 bp, Homo sapiens
tggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagcttgatgccctcctgtatagagccaccatgattcttacagttggtggaacagcatatgccatatatgagctggctgtggcttcatttcccaagaagcaggagtgactccagtcatcccagcaatcgcttggttcagtttcattcagctctctatggaccagtaatctgataaataaccgagctcttctttggggatcaatatttattgacttgtagtaact

SEQ ID NO: 41152 - DNA, 461 bp, Homo sapiens
  misc_feature 129: n = A,T,C or G
cattcacaaaatatttatgatgtatttactctgcaccaggtcccatgccaagcactggggacacagttatggcaaagtagacaaagcatttgttcatttggagcttagagtccaggaggaatacattangataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataaga

SEQ ID NO: 41153 - DNA, 241 bp, Homo sapiens
  misc_feature 241: n = A,T,C or G
agctcttggcaccattattctgctttctgtttttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatgattgagttgcn

SEQ ID NO: 41154 - DNA, 327 bp, Homo sapiens
tgcaagaggcctagcttttggcctatctcagctttcaacatgccttcctcagtaagcttaatcgtttctagcttttgatttaaagtgagggatgtacaaatcttctttcacttgaacacttagatccattttggggttattaatggcctaatttcaatattgttgtgtctctgggaatagagaggccaaggagaggaagaaagatgggggaacagctggtcagtggcatagttacaacacacacaacatttataaattaagtttgccatcttacaaaagtctaatatccagcatttataagggatcttggcaaaaaaaaccaaaacc

SEQ ID NO: 41155 - DNA, 459 bp, Homo sapiens
gtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagaggtccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggtcaggaatcacaagctccgggtggataaggcagctgctgcagcagcggcactacaagccaaatcagatgagaaggcggcgggttgcagggcaagaagcctgtggtaggtaagaaaggaaaga

SEQ ID NO: 41156 - DNA, 129 bp, Homo sapiens
aactgacggatgtaaggtgcacgtttcctgatgtgacgcactgtattccagctggtgatcaagtctgggaacagccgtaacaggtcaaccttgtggagccatcgcgagttagagggtgaaagatggcag

SEQ ID NO: 41157 - DNA, 470 bp, Homo sapiens
  misc_feature 7: n = A,T,C or G
tcccaantgctttgattacaggggtgagccactgcacctggccttaatttttcttacctaattgcactggctagaaccttccgtacaatattgagtagaaatggcttgattgctattgtcttatttctgacattagggagaaagaaggatgaagtatgatattagctgtgggctttttatcaatgccctttctcaggtcaaggaaactcttttctactcctaatcatcaacaaatggtaccactactggataacattgtcatgaggtgtatatatgtgatatgtctaatacagtgtgatcagcatatagaaggtggtgaatatttatttcttttggctgccaacctcgaagttactgattaaaacattaaatgtgtcagaggccatcagcatgcgatttgatttctgtaggccctccatggaaaaaccattaaaaattctgttttcttttccatggggatgttgagatct

SEQ ID NO: 41158 - DNA, 343 bp, Homo sapiens
  misc_feature 29, 208: n = A,T,C or G
accgccaggctgtttcagccaggaaggcntaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcnggatctcacaggctgagaactcgttcacctccaagcatttcatgaaaaagctgcttcttattaatcatacaaactctcaccatgatgtgaagagtttcacaaatccttcaaaataaaaagtaatgacttagaaac

SEQ ID NO: 41159 - DNA, 415 bp, Homo sapiens
gatcacttggcaggggagggaggagagtgttaacagttacttcttggagaaggctctgttggggctcagtagctggcctggcctgtggagaattctagagaattccagggtgtctctaagggagggctggagcaaggccgtcttggagtagcagcagtcagatagacgatgctgccagaggctgaggaccttctctagaaaggggtgtctttgattcagtgggtgggttttaacttgtaaaataaggcaaagttgtgagatagttctctagcattaataaattcaatctgggagtggtggctcacgcctgtagtctcagcacttttggaggccgaggcgggtggatcacctgaggtcaggagtttgagaccagcctggccaacatggcaaaacatccgtctctgctgaaaagtac

SEQ ID NO: 41160 - DNA, 322 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttt

SEQ ID NO: 41161 - DNA, 182 bp, Homo sapiens
atgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctgga

SEQ ID NO: 41162 - DNA, 477 bp, Homo sapiens
atggaaagagatttgattttccagcatgcatggagctgtctctttgttattacctgccagtgtcatgttgctgctgttttgctgtcttgtgtccatgcagatgtctcttaattatgcatttgtgttcataattttccttcctactcatgttcttattcctgcctggaacacctctagcagaaggtgaatttgactaaggtcaaatttttgcagcctttttctacttctggattttgtgtcatgcttagtaaggccttcccccactataaaattgttttttaattccaaaaaagtaaaagcgtttttgaccttgggcctgacccagatcatacttttcctggttcctgatcacctctgccataattaattttgtcttccttgtcctttttcctatatactatatgcaattatggtcatttgtataaatatcctatcattctacctaaacagaaagttctgaaggtcgacagttgcatc

SEQ ID NO: 41163 - DNA, 346 bp, Homo sapiens
aggattgacttggatgcattcttttaggctaggtctaatattggttattttgtgtaaatgatattagtagaattttaaagggtagtatgagatggtaaatgtaaaatatttgaaattaaaagttttgcacaaatgcaatgtaattattgttgcttctgttgttagtattatatacccaccataaagaccaatacatttgagaaataaaagtaaactctatgaaatttattcctggtaatcacagatagcaacaacgaaagttcacagtgaaggatatttgagagaggacattattatgaaaagctgttgatttattttgcatttttttctgtggacttaccttaca

SEQ ID NO: 41164 - DNA, 487 bp, Homo sapiens
  misc_feature 25, 36: n = A,T,C or G
cattcccttaatgtgaccttcaagnaaagattattngccagcctcctatgtttttgcatctaattttccctaaattttattggttaaaaagggtactgctacttgttactagtaaaaaccctaaattgtttggaagtgctctttaaactgatgtatggcaaagtagttaatttaagccaagtactatgtgtcatgtaggtggtcagtaaatactggtagaaacaaccactcagtaattttaaaccatgctggagagccaacaaacaactccattaaaaacgaaaagtatgtgcccctaaagaacagctatgtctgacagtatttgtgaactgtggatccaagaatagggaatgagaatggtgtatttggagagtgggagtggagctgggagaggaaaggaatgatatgggcacattccatgtcgccggcttagaggttgtggagaacctagtcatggcaagaaatagaatccattgaagacaatgta

SEQ ID NO: 41165 - DNA, 153 bp, Homo sapiens
tatttagagaaaagtaaaatagtttgaaaatagtgctatagggattttctgatactgctaaaaaatgaaggtttggcaatgagtattttttctataatatgaagatagtgctctgactctttataatcctaagttagcgccccccgccccacc

SEQ ID NO: 41166 - DNA, 475 bp, Homo sapiens
cttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttga

SEQ ID NO: 41167 - DNA, 467 bp, Homo sapiens
gatggttagtaatgattgtagtgattagaacaatggttttggggcatagtccacagtaggaaaaatgcaaaaccctacattgatttgtggggccagagagagaaaggtgccctgatgaggcagaagctcccagagagagaatggctgtaatgtaaggccagacaagtagcccacagatagataacagaaattcctagttaccagccaaccacagcaagcaatggaatgagttctgtgccttcaggtatggcagggaaccagcagagagcctgagtcatcaagcctaaatgaagctctgtggataagagtgacagccatcttgaagcctcttggatggattcaccgctagggacacagagacttcccctgcccttgtcaccccaacacttcagcaccaagtaagtcaccccaccaacataaacatagtaacaagtatggaaggtaagggagaagagatatcctgaggt

SEQ ID NO: 41168 - DNA, 386 bp, Homo sapiens
  misc_feature 297: n = A,T,C or G
atggcggtggaggccaatactttgcaaaaccacgaaaccaaggtggctatggcggttccagcagcagcagtagctatggcagtggcagaagattttaattaggaaacaaagcttagcaggagaggagagccaggagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggtnattttagtttctgttctgtggaaagtgtaaagcattccaacaaagggttttaatgtagattttttttttgcaccccatgctgttgattg

SEQ ID NO: 41169 - DNA, 387 bp, Homo sapiens
  misc_feature 7, 21, 386: n = A,T,C or G
gacagtnaagcccaaaaccgnaagacattgatgaggaagatgatgatgttccagatcttgtagaaaattttgatgaggcatcaaagaatgaagctaactaaaagtttggtttttggaagctggcatggactatgatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggng

SEQ ID NO: 41170 - DNA, 207 bp, Homo sapiens
tagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatctt

SEQ ID NO: 41171 - DNA, 359 bp, Homo sapiens
attggagatataagacatacttctcacatatttagatgacacaggttagtacattgaatatcagccagggtttttaaggatcttaatagagtggaactaaggtagaaactattaagagcaattaatagtgatatatctatagtcctgtttctaaacaagtttttttaaaaacctcaactctgactatagtgaacagagaagtcttggactcttacaattcatgtgagaagacctgaaactttgataacaattatatacattttgtgagtaatttctttggtgtatgccttcacatatctctggtatgtgacctatgctgcagtccattgagcatagattcccagaatgtattctcctac

SEQ ID NO: 41172 - DNA, 493 bp, Homo sapiens
  misc_feature 4, 10, 487: n = A,T,C or G
cccngggaantcggcctttatggccgaggttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggngggaag

SEQ ID NO: 41173 - DNA, 437 bp, Homo sapiens
agaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaag

SEQ ID NO: 41174 - DNA, 491 bp, Homo sapiens
  misc_feature 16, 24, 31, 32, 54, 57, 82, 96, 104, 128, 198, 228, 231,236, 280, 297, 315, 325, 349, 359, 384, 401, 412, 481, 489: n = A,T,C or G
gaaaatccattaggtnagcataantatgaanntttaatattctgtggtgccagngcncactaccttcccacccatacacatncatgttcactgtancaaactgnatattcacaataaagcttctgagnaacactttctgattactcatgataaactgacatggctaacttgcaagaattaaatcttctatctgagagnaataatttatgatgactcagtggtgccaanagnaaagnctctaaaataacattcctctcacttggaccccactaaaagtatnagtctacacattacatngaagttaaacacaaaatnatcagtgttntagaaacatgagtccggactgtgnaagtaaaagnacaaacattatttccaccataaagnatgtattgaaatcaagntgtctctgtgnacatgaatacatacttattcccatttttaagcatttgcttctgttttccctacctagaatgacagatgnttttcagnta

SEQ ID NO: 41175 - DNA, 369 bp, Homo sapiens
  misc_feature 157, 171, 287, 331: n = A,T,C or G
agagaaccagtcttggatctcccttctctactttgttactgaaatcttgaacctgtagaacattacttatcactgtgttcctttctaatgggaaaataataataaacacttgcagagtattttttaaaagtttttagctttaaaaaaaaaaccctgngccttacacaatgngtatattgagttgatactgattatgataattagatggtattatacaatcattcattcagcaaacattcacttactgagcaccctactaatgttccaggtactgattgttaaaaggngattgagacacagcctctgtcctgagcttagtctagtaggaggngacagatttgtaaataatagatttggaaggtgctgagc

SEQ ID NO: 41176 - DNA, 168 bp, Homo sapiens
gagtacggcaaatatggcggagccatctgttgaatcttcaagtccagaaatggatgaaaggtttgactgcccatgaaagtacaggaggttcagcaacatcagatgaccatgaatttgatccatcagctgacatgctggttcatgattttgatgatgaacgaacattag

SEQ ID NO: 41177 - DNA, 466 bp, Homo sapiens
  misc_feature 7, 34, 43: n = A,T,C or G
aacatgnagactggcgagtacttgcgtctacccnaatccagcnaacgttcccaagaaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacat

SEQ ID NO: 41178 - DNA, 101 bp, Homo sapiens
  misc_feature 12, 20, 62, 79, 83, 87: n = A,T,C or G
agagtctccagnttcaagtntcccaaagttacttaaatgaaaccttttcccctgacatccgnattttaattttattttnaatnaatngatctaaattacat

SEQ ID NO: 41179 - DNA, 458 bp, Homo sapiens
  misc_feature 4, 12, 29, 156: n = A,T,C or G
gacncgccggangaaagaggaagactacnaggctgcggaggagactgcttttgttgttgatgaagtgagcaacattgtaaaagaggctatagaaagcgcaattggtggtaacgcttatcaacacagcaaagtgaaccagtggaccacaaatgtggnagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttg

SEQ ID NO: 41180 - DNA, 133 bp, Homo sapiens
  misc_feature 132: n = A,T,C or G
catctacgtgtgagcacccaagggtaacaaccagtatggcttcactgaaacctgcttttgtaaattacttttttttactgttgctggaagtgtcccacctgctgctcataataaatgcagatgtctatgcanc

SEQ ID NO: 41181 - DNA, 466 bp, Homo sapiens
  misc_feature 33, 455: n = A,T,C or G
gaggcgagggcgccgcacccacaccgcgctgcncagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggngggcacaactg

SEQ ID NO: 41182 - DNA, 475 bp, Homo sapiens
  misc_feature 7, 19: n = A,T,C or G
ctgtganttctaattaatnccgctggccattacacaggttttgttgtttggggtggggagggggcttttgttccctttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaaggtattttcattatatgaaagctaccat

SEQ ID NO: 41183 - DNA, 126 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcct

SEQ ID NO: 41184 - DNA, 467 bp, Homo sapiens
  misc_feature 261, 376, 447, 459: n = A,T,C or G
agttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcatatgtatactgtaacccagtaaattttgcattcagttttaaaaaatgaagatgtaacttacctgagtctcatttttgaaaatgaaattctgcaaaaattatttaaaaattagntcttggggaaattgattttcaagattcaagtgtataaaaacttatattgaacttttcagcctcgtttttaattagctgatgttaatgataagatacataatacatgtatcttgtngctgaaaatattttttgcatttcaacacattgagttaaaataaagttgttactacttattcaagattaatnggcttatcttgngtttattt

SEQ ID NO: 41185 - DNA, 490 bp, Homo sapiens
  misc_feature 33, 211: n = A,T,C or G
caaagccctaagccttgatgactttaagggganatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggnttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagct

SEQ ID NO: 41186 - DNA, 199 bp, Homo sapiens
cattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttcc

SEQ ID NO: 41187 - DNA, 475 bp, Homo sapiens
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggagggaagaagaggagacttcaaatgaaggagaaaacaatgaagaatcgaatgaagatgaagactctgaggctgagaataccacactttctgctacaacactgggctatggagaggacgccacgcctggcacagggtatacaggggtt

SEQ ID NO: 41188 - DNA, 466 bp, Homo sapiens
  misc_feature 34: n = A,T,C or G
ctcacagcaacctgtggatgaatactgtattcangcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaaagatgataaaacagttttggatcttgctgtggttttgtttgaaacagcaac

SEQ ID NO: 41189 - DNA, 167 bp, Homo sapiens
  misc_feature 32: n = A,T,C or G
ctactaaaaatacaaaaaattagccggcgtgntggcacgtgcctgtagtcccagctactccggaggctgaggcaggagaatggcgtgaacccgggaggcggagcttgcagtgagctgagatggcgccactgcactccagcctaggcaacagagcaagactccgtctc

SEQ ID NO: 41190 - DNA, 466 bp, Homo sapiens
  misc_feature 6, 34: n = A,T,C or G
agggantgaagaagctctcctacatccgcattgntgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttagacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgc

SEQ ID NO: 41191 - DNA, 479 bp, Homo sapiens
  misc_feature 31: n = A,T,C or G
aatccaacttacaagggatgtgaaggacctnttcaaggagaactacaaaacattgctcaacaaaataaaagaggacacaaacaaatggaagaacattccctgctcatgggttggaagaatcaatatcgttaaaatggccatactgcccaaggtaatttatagattcaatgccatcaccatcaagctaccaatgactttcttcacagatttggaaaaaactactttaaagttcatatggaaccaaaaaagagcctgccttgccaagacaatcctaagccaaaagaacaaagctggaggcatcacgctacctgacttcaaactatactacaaggctacagtaaccaaaacagcatggtactggtaccaaaacagagacatagaccaatggaacagaacagaggcctcagaaataacaccacacatctacaactatctgatcgttgacaaacctgacaaaaacaagaaatgggggaaaggat

SEQ ID NO: 41192 - DNA, 465 bp, Homo sapiens
  misc_feature 33: n = A,T,C or G
gacccggcgctccattaaatagccgtagacggnacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattttgtggccgagtgtaacaaccatataataaatcacctcttccgctgttttagctgaagaatt

SEQ ID NO: 41193 - DNA, 453 bp, Homo sapiens
taagccttggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccg

SEQ ID NO: 41194 - DNA, 247 bp, Homo sapiens
  misc_feature 121, 148, 246, 247: n = A,T,C or G
caatactttctgggttaaaaaaattttttaatataggaaagtccaaagactagtatgagaaacacctatggctcaccacccagaattaacaaatatcaacatttgttcatgtttgccttgnatattttaataacacatctaaaatggngcagataaaatgtaggtcttctttattcttccagtcccattctttctcctccatagagataaccactctcctagagagagtgtgcaacccttccagcnn

SEQ ID NO: 41195 - DNA, 153 bp, Homo sapiens
  misc_feature 7: n = A,T,C or G
tgtctgnctgtaagaaaaaaatatatatctctatgtcatatagcgtgttagcaggtttattttttaaatgaaaggtaagaaagaaattgatttgaaatatataccacaagaagtcccgtgtcctgtcaaactgtcagtattttataaataaac

SEQ ID NO: 41196 - DNA, 190 bp, Homo sapiens
agagagcagagtaaaaagaaaacaaattccctttgttttaatgaacccactaatgcaataacggtattgattaatttcattttgccctcatggcctaatcagctttcattaggccctactcccccacactgttgcattgggaattaagtttccaaaagatgtttttttggtgacacattcaaactgtaac

SEQ ID NO: 41197 - DNA, 464 bp, Homo sapiens
  misc_feature 16, 19, 58, 184, 231, 379, 445: n = A,T,C or G
ggaggggggcggcgcngangagaggtatttttaaagatctggccctctcttcaggatnatttgtggagaactctaaggttaagatcaggaaataaaagactgtgtgtgtgtgtgtgtgtgcgtgtgtgtgttcaagtgcctaaatcttgtttacctatcactttaaaaaaataattgaagtgtnagctaaataaaatgcttggagttttgcctgggctagtgagagttggngcaaattcttgtgtgtgtttgcataggaaggtgagatgaccatctactaaagaggaagtagctaaatacagatctgtgggtgtttttaaaaaaactcaacctatctggtgttttattttaatggataaaaatgtaatttttctaaggnagcaacttatttccaaattaatatagatgaaaaatagataccaattagactaaattgaaagctttntgttctatatttgcatagc

SEQ ID NO: 41198 - DNA, 477 bp, Homo sapiens
gaaacctaagtagaagttaataccaatagtggtgaaattatgcacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgagggaagaagagtttgaagaactcaaaggctctgaaccccacatgagaactagaaatcaaggtcgaaggacagctttctataatgaggatgactctgaagaggagcaaaggcagcttgttgttcgaagacacctctttaacttttg

SEQ ID NO: 41199 - DNA, 161 bp, Homo sapiens
agttatattaatgttgaaagtgctttgaagtcgcttgataaaaggtgctatgaatagcaacttactgtgttactacacttgcctttttggcattggttgatttataattttggtaaaggatcctaaaaccctgtattctttttctgtgccccataatgacg

SEQ ID NO: 41200 - DNA, 463 bp, Homo sapiens
  misc_feature 20, 120, 269, 397: n = A,T,C or G
caaggaatcccgggccaagnaaattccagcggcagcatatggactcagacagttcccccagcagcagctccacctactgtaaccaaatgatgaggcgccggaatatgacacaggggcggngcaaaccagtgaacacctttgtgcgcgagcccctggtagatgtccagaatgtctgtttccaggaaaaggtcacctgcaagaacgggcagggcaactgctacaagagcaactccagcatgcacatcacagactgccgcctgacaaacggntccaggtaccccaactgtgcataccggaccagcccgaaggagagacacatcatttgtggcctgtgaagggagcccatatgtgccagtccactttgatgcttctggggaggactctacctaaggtcaanagcagcgagataccccacctccctaaaccttattcctttccaaagctgccttttcctttttccttc

SEQ ID NO: 41201 - DNA, 327 bp, Homo sapiens
attgaagggacagcccggtgctcctggtgtgaaggtaaatattaaattagaagcactgtttttaagcacttgattgaaattccccatgacctccaaaaaagtatattatactgaagactacccatattacaaaaagtatttttattttttttctttcctgtacttcaaatccctcaaggatggggactatgagagtctgtgaaaaaaggtcaattattaatatttattaaaattcaatatctattaaacaattgagataaaaataatattaatagtttcttgttccatttcctttcctccctctataatttcagtgtatctctgcag

SEQ ID NO: 41202 - DNA, 447 bp, Homo sapiens
ctaagcaaagtggttaaaaaacaaacaaatcccaagtggcttgatctgacttacaaactctaacaatgtgtagctaattgcagatagattttattattcacagtattgtgtcaagtctcctgtgcgcatcttctgtattggagcataagtaatggagatgttatcttgcccaacattaggtttgaggaagtcgtttttaagacagaaatagtagaacagtgttattccatactgtactttccccttttatataagcttgctaaaattaaggttgggcaataggcccttgagctaaatgtgacctgatagaaagttttagcaacaatgaaaaaaattataactatctaatatacatatctaatattaggatatttacccttacttacatatcatgcacaatcaaacaaatggcaattataactacattcttttttacttgccataatg

SEQ ID NO: 41203 - DNA, 477 bp, Homo sapiens
  misc_feature 219, 312, 422, 473: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaagcttcttcatggagtaaaaaatgtatttaaaagaaaatngagagaaaggactacagagccccgaattaataccaatagaagggcaatgcttttagattaaaatgaaggtgacttaaacagcttaaagtttagtttaaaagttgtagggngattaaaataatttggaaggcgatcttttaaaaagagattaaaccgaaggngatt

SEQ ID NO: 41204 - DNA, 175 bp, Homo sapiens
gtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacacgaatacacgttactgatctt

SEQ ID NO: 41205 - DNA, 488 bp, Homo sapiens
  misc_feature 1, 5, 466, 480: n = A,T,C or G
naganactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccggcccgaaagganaaacacatcattgnggcctgtg

SEQ ID NO: 41206 - DNA, 465 bp, Homo sapiens
  misc_feature 17: n = A,T,C or G
ctaccatgttgcccagnactggtcccgaactcctgggctcaagcaatccgcctgcctcagttcccaaagtgctgggattacaggtgtgagccaccatgcccagcgcaatttctgattctatatttcaatgcagattttcatagcatgtatctctactcagttcatataaatcttaaggcaagagcctactagtcatggcctacccatcataattaactcatttgtcttggaaaaagtgaacttcattcctgtattttcatgcatacaaaaacaagaaacatacaaaccacaataacaacaaacccatcaagatcctccaatgcacataatcactctacagatgttttattcttttacctattttgctgtaattatctgcaacaaagtcttccaaaccaatcattttccagaaactgtcgtcccagcctttctctgctgaatatgtccacttacacaccagggagc

SEQ ID NO: 41207 - DNA, 328 bp, Homo sapiens
  misc_feature 6, 32: n = A,T,C or G
cacccnaacacttctgctttcacttaagtgtntggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattgc

SEQ ID NO: 41208 - DNA, 461 bp, Homo sapiens
  misc_feature 2, 3, 28, 70, 165, 167, 284, 337, 406: n = A,T,C or G
gnnggtcacacttattctactggatatnactgttcctgggccctgccaccactctcagccctggtgctgnggattctgttcatgagaggggctgaagtcaagcctccctctcaggcccagatctgagtctacaggtcagccggggctggggcctcacggtagcangnggtgacagaggacatgtcacttgtcgcagtcactggggacactggttctcatagcccagcctctgtgcctggacctcagctataggcctggccccattgagctctccctgatgagantctccaggccttgagctacctgactcttcccagttggccagacacatcccagngaatgatcatcatcctgctctcatctcatagccagctgatcagtctgttcaccctccacctactcaagnacagagtgacacaccccaagcaacaatcgcatgagaaattctaccacctggggag

SEQ ID NO: 41209 - DNA, 488 bp, Homo sapiens
  misc_feature 4: n = A,T,C or G
agcncggccatggcgctcctgctttcggtgctgcgtgtactgctgggcggcttcttcgcgctcgtggggttggccaagctctcggaggagatctcggctccagtttcggagcggatgaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctc

SEQ ID NO: 41210 - DNA, 421 bp, Homo sapiens
  misc_feature 19: n = A,T,C or G
gagttactgtgagccaagnaacttttataaaacctagaaggggaggcagacattttaaataagcaatgtaaggcagagtcgggtgagtgctatactagaggtaaacatcagatgacctggtatgaatcctggtttactaaggacaatcttgatttttgcctgttgcccagaggtaattatgatagcacctgtttgtactatcagaagagtctcagttattaaattatagtcatataaattataaactaagtacagttgaagtgaaaagaaattattagttctgactgggaggttggggaaaggtttctataggagaggatgtttgagctgaacctagaagaacaggtttagaaagagaaaccatcataggctgagaacagttcaggcaaagccttggtggcctccaaggacacttgtatga

SEQ ID NO: 41211 - DNA, 247 bp, Homo sapiens
aattcttactttttgctttatacctttctataatatttagatttttttttactgtaagtatggatcaaattgcaaaataaagaaaaatgccaaccttagaaaagacaataaatgcacaaaagatataaacaggaacagcaaatatttatatttttcccattttgctctttttaaatctatgtttagaactttatatcttgggacttatgtatatatataccttttaaataaaataaattttctaaat

SEQ ID NO: 41212 - DNA, 454 bp, Homo sapiens
  misc_feature 22: n = A,T,C or G
ccaatttctgcgcattcttgcnacactagttattatctgactttctggttataatcattctaatgagtgtgaagtagcctctggtgtcatttggatttgcatttctctgatgagtgatgctatcaagcacctttgctggtgctgttgaccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaaga

SEQ ID NO: 41213 - DNA, 456 bp, Homo sapiens
  misc_feature 6, 32: n = A,T,C or G
agattngttcaaacatatacatgatagcaaanatttagagtaaaggacattcaattatttaatactgtcaaggcaaactggaatgagaatgtgttcttgcttttactcttgctgcccctatagtttaatcttcatacagagaccaaagtcatccttttaaaatgcaaattaggttgggcacgatggctcatgccagtaatcccagcactttgggaggcccgaggcggttggatcgcttgaggtcaggagtttgagaccagcctgatcagtgtggtaaaacaccatctctactgaaaatacaaaaaattggccaggcatggtaagtgtgcacctgtagttccagctccttggagggctgaggcgggagaatcacttgagccttgggggcagaggttgcagtgagccaagattgtgccactatactctagcctgggctacagagcaagactccatcac

SEQ ID NO: 41214 - DNA, 360 bp, Homo sapiens
  misc_feature 16: n = A,T,C or G
ctcctttgagcatagnagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaag

SEQ ID NO: 41215 - DNA, 468 bp, Homo sapiens
  misc_feature 246: n = A,T,C or G
cgagcaggaattcggtgtggacatagggccggtctgcttcttgtaaaaacctgaacccagaaacaacacaatccgctgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatga

SEQ ID NO: 41216 - DNA, 390 bp, Homo sapiens
  misc_feature 2, 3, 6, 8, 9, 16, 23, 34, 71: n = A,T,C or G
gnncgntnnttcgagntggctgnagatttgtggngcgtatctgagccgtctgtcctgcgccaagatgcttnaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcagcactaaccagatttacttggagtacatgtgaaagaaaacgtcagtctgcctgtaaatttcagcaagccgtgttagatggggagcgtggaacggtcactgtacacttgtataagtaccgtttacttcatggcatgaataaatggatctgtgagatg

SEQ ID NO: 41217 - DNA, 431 bp, Homo sapiens
  misc_feature 14, 56: n = A,T,C or G
aacgatgatcgganaatcctgctgttcgggacgttgctgatgaatgccggggcggngctgaactttaagctgaaaaaccaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcact

SEQ ID NO: 41218 - DNA, 152 bp, Homo sapiens
  misc_feature 17: n = A,T,C or G
tcatttgggataaagtnaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 41219 - DNA, 463 bp, Homo sapiens
  misc_feature 31: n = A,T,C or G
gaacaccacccagtgtggagcagcccagccnagcactgtcaggaatcctgtgaagcagctccagctatgtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatccctcatcctcccttgagaagagttacgagttgcctgatgggcaagtgatcaccatcggaaatgaacggtttccgctgccagagacccctgttccagccatcctttcattcggga

SEQ ID NO: 41220 - DNA, 216 bp, Homo sapiens
  misc_feature 6, 9, 116, 215: n = A,T,C or G
ctggcngtngtggccgggagtaaagactggtaatgataacaatgcatcgtaaaaccttcgaaggaaaggagaatgttttgtggaccactttggttttcttttttgcgtgtggcagntttaagttattatgtttttaaaatcagtactttttaatggaaacaacttgaccaaaaatttgtcacagaattttgagacccattaaaaaagttaaatgng

SEQ ID NO: 41221 - DNA, 476 bp, Homo sapiens
  misc_feature 21: n = A,T,C or G
gagagactacgggagagaagnacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttg

SEQ ID NO: 41222 - DNA, 471 bp, Homo sapiens
cacacagggctcactgagaataagaaacatccttcttgggctttgtatgaataagaaagaaataaactttcattgtgttaagccactgagatttatggatttattaaagcatctagcattacttatactaatacagagattaaatctagtgatatgtagaagagataatatattatgactaagttgaatgtatcctagtagagttataccatattcatagatcagaagtctcaaattatatatatctgtgccacataagataatctctgtagagttgatgaaatatcaatcagaatcccaagaaatactttttgaaagaacttcaacaactgattctaaagttcacagagaaaatagaacagaagacactgaagaagaacaaggtgagagggtttgcactgcaatatattgagactaattttaaagctataataatgaacatacagtggcagtggcacaaataccaaatgc

SEQ ID NO: 41223 - DNA, 139 bp, Homo sapiens
gtttgacttaccttagatttttattttcctacatactgcagatgattgacttgttgcataaatgaagatcttctgttgtgtgcttttcaaacactgtaaataaatttgaaatttgaataactttccacagtataactgt

SEQ ID NO: 41224 - DNA, 478 bp, Homo sapiens
aagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaggtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaaagtaaaacttgctgctg

SEQ ID NO: 41225 - DNA, 477 bp, Homo sapiens
  misc_feature 472: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaacccgaaggngatta

SEQ ID NO: 41226 - DNA, 219 bp, Homo sapiens
  misc_feature 124: n = A,T,C or G
gaggcattgaggcagccagcgcaggggcttctgctgagggggcaggcggagcttgaggaaaccgcagataagtttttttctctttgaaagatagagattaatacaactacttaaaaaatatagncaataggttactaagatattgcttagcgttaagtttttaacgtaattttaatagcttaagattttaagagaaaatatgaagacttagaagagtgg

SEQ ID NO: 41227 - DNA, 199 bp, Homo sapiens
  misc_feature 50: n = A,T,C or G
cattgcaatttgtattttagcagatttcagcaactatcctaaacaatgtnattgtgttccattttaactgggataaatgtttttgtaaaaatacaaccatagaaaggcctctttgttacaaaatgatttgcaaagaaataactgctttgtttgcaagattaaattagtgttggcaaaataaagttctaaagataatact

SEQ ID NO: 41228 - DNA, 215 bp, Homo sapiens
  misc_feature 215: n = A,T,C or G
gtaccctatatatggaattataactgattcatatattgtatgtgctatttaaagtttatatattcaggccaggcatggtggtgcatgcctatagttccagcactttgggaggccaaagtgggagaatcacctgagcccaggaggtcgaggctgcaatgagccataattgtgccactgccctacaacctggacaacagtgcgcgatcttgtctcan

SEQ ID NO: 41229 - DNA, 129 bp, Homo sapiens
tcttcaaggtttactaaaggcaactgtcattggaaatctgttacaggatgaaactatttctccattatgtaattgaatgtacccagaatcagctgttattactgtcttacaggtaataacacttttccc

SEQ ID NO: 41230 - DNA, 192 bp, Homo sapiens
  misc_feature 39, 87, 89: n = A,T,C or G
atgtttgttgaatgaatgaatcatcaatccaattaattnataaactaatcatgattttagtgagtattctatgaaccctcacttagntngattaccttgactgtgacatttaactttgtatttcactacttctttgcttctcttacattcagttaaaaatatttttaaaatacaattttcaaggttcagaac

SEQ ID NO: 41231 - DNA, 466 bp, Homo sapiens
aataaatagtgaccctttccgaacccaagttctaaacaggtggaaacataaataaaatagtaaatacagagaccaaggaggttgccttatttctgaagcagctaagcagcaggcatggctttaggtctcttagccaagtggggtagcttgacattcagtcccagtattaagcagctgtgcccacccagacaggcaacaccgtaaggcttagatgggggttctgcccagaatagttttaacatggaggaacacaggaaaactcaggctttctgctggcagcttgctcccaggacaaagaagggtggagttgagcagagcctatagagttattcttcccaaatttacccacaaatcaaccactcccctctcacaggagtagagtgaggaaaggggtagagaggtctggagtttcactcactgtgctccctgcatataaaggagacatcagaagtgtggaagaagtgtc

SEQ ID NO: 41232 - DNA, 455 bp, Homo sapiens
  misc_feature 454: n = A,T,C or G
cagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcgaatagcgattctcttcatgtgtctcctaatgccttacactacttggtttctgatttgctctatttcagcagatcttttctacctactttgtgtgatcaaaaaagaagagttaaaacaacacatgtaaatgccttttgatatttatggggaatgcctctcatttaaaaatagaaataaagcattttnc

SEQ ID NO: 41233 - DNA, 468 bp, Homo sapiens
gttatttttattaactcctcctgtatatgtaagtgtacatgtatttctcagaagctagtaatagtgcgggcacgtgaaacaatacagctttcttaaatttgcagctgaaacttagaaggcacttggacattgtgtgtaatttttttccagttgaggtgtaacatagtaatatcacaagtgtacagctaatgtatactaagtgaacagctagatgaattgttacatatgcacatgtctgtggtaaccagtacccagatggagatatagaacatttccttggccttagaaagctccctggtgcccatcccaggcagccctccctcttgctagcaggcagcagctattctgaagagttggaatagatgaagttttgcctgttcgtgaactgtatgaacatggacccctacagtatgtagtcttatgttgggagttcttgcactgctcaataatgagcattgtaatagacat

SEQ ID NO: 41234 - DNA, 469 bp, Homo sapiens
  misc_feature 10, 264, 290, 379, 443: n = A,T,C or G
ctcaaacagnaaatgatcatttttaaaaagaaccactatcaaattgaattttccatctcattatcagcttctgtaataaactatgttttattagactcctatctatatggttttcagttctgtgattacacttccattttgaattgctaatttttggccattcgtcacttaaaaatgaatattttaacgtgatgatttggtattttaatatgcaggtattcaatcttttacatgatagctattagattgtttaatttacaaagntggtagtaaaatgaaatcttatttgnttactagcttttataagttgattttagtgtagatttatgtagcatattacagttttacatgtggaaataacattaatttttaacccttntgaaaaatcagctttgattttacttttatcatctggagaaactatgtttctagacaagaattgnatgccattaatctatcactatgaaat

SEQ ID NO: 41235 - DNA, 118 bp, Homo sapiens
  misc_feature 24, 31: n = A,T,C or G
agttgttatcaaattgtaaaatcngtaatgngatattttatattctgaaacatttctactttctgctaaaatcaattttaatttagtttaattgaatgatttatgatgaatcttggcc

SEQ ID NO: 41236 - DNA, 183 bp, Homo sapiens
  misc_feature 1, 4, 99: n = A,T,C or G
ngcntctgcgcaaaaatataaaaattagcctgggcatggtgggacactcctgtaagtccagctactcaggatcctcctgagtgatcctcaaggaggatnacttgagcccaggcggcagaggttacagtgagctgaaatcaccctactgcactccagcctgggtgctagagtggggtgttgtct

SEQ ID NO: 41237 - DNA, 281 bp, Homo sapiens
  misc_feature 26: n = A,T,C or G
catatgataagaaaagagctcacagnagtatagttatggagaacagaggccttaagaccatgtgggcagtagtgaggatttggcattttatttccagtgagagaggaggccattttcatgagagatttgacaggatctcacttaaaatttaaaagtaatcaggccgggcacgatggctcatgcccggtagtcccagcaccttgggaggccaaggtgggaggactgcttgaaccctggggttcaggactagcctgggcaacatagggagagtgtgtgtctgc

SEQ ID NO: 41238 - DNA, 468 bp, Homo sapiens
aacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcgctttgctggggtgcaggtggaggaggctattattctta

SEQ ID NO: 41239 - DNA, 472 bp, Homo sapiens
aataaggaaaatatgatagatatcaataacaaaagtacagctagaacggggcacagtggctcatgcctgtaatcccagcacttagggaggctgaggtgggcagatcacttgagctcagtagttcaagaccaactttggcaacatagctaaaccctctgtctacaaaaaatacaaaaatttgacaggtgcagtggcatgtgcctatagtcccagctactcaggaggctgaggtgggaggatcgcatgagcccaggagttcgaggttgcagtgagccgagatcgtgccattgcaccccagcctgggtgatagggagtgaaaccttgtctcaaaaatgaaaaaaacaaaagctacagctagaaagtttctacatgtttgaaaattaattagtatatttctaaataatccacagattgaaaaagaataaagtgatgaaaatacagaatgtctacatttgtgagatatggctaaaac

SEQ ID NO: 41240 - DNA, 247 bp, Homo sapiens
  misc_feature 67: n = A,T,C or G
caagaaaggcaaaccagagctcagtaaaaaaggtacatccagcagtggtcattcgacaacgaaagtnataccgtagaaaagatggcgtgtttctttattttgaagataatgcaggagtcatagtgaacaataaaggcgagatgaaaggttctgccattacaggaccagtagcaaaggagtgtgcagactttgtggccccggattgcatccaatgctggcagcattgcatgattccccagtatatttg

SEQ ID NO: 41241 - DNA, 264 bp, Homo sapiens
gatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttcc

SEQ ID NO: 41242 - DNA, 420 bp, Homo sapiens
  misc_feature 420: n = A,T,C or G
agacagtgagtagcgtctatggaaccacactgccggggctcaaatcttgaaatcttggttctgccacatggttgctctgcagctctggccaagttacttacttgccttatgcttcaatttcctctaatgtaacccatggatcagttaccctgggtatggcactcagaagcacctgctacatagtcagctctaaagagttcgttatttctattatttcacctaggaaagatattcccaacttttgacatcgattccccagggtagggttaatctcttagagtaatactctaaaatcttatatggaccaggcacagtggctcacatatgtcattccagcatttggggaggctgaggcaggaggatccattgagttcaggagttcaagaccggtctgggcaatgtagtaagacaccatctctn

SEQ ID NO: 41243 - DNA, 469 bp, Homo sapiens
ctgggaggggagaaggagttggagctcaagttggagacagcgaggagaaacctgccatagccagggtgtgtctttgatcctcttcaggaggtgaggacaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacccgtgacctgcactcacaatatctgctatgctgtagtgctaggattgattatgtgttctccaaagatgctgctcccaagggctgccaagtgtttgcca

SEQ ID NO: 41244 - DNA, 469 bp, Homo sapiens
acagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccattggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagta

SEQ ID NO: 41245 - DNA, 101 bp, Homo sapiens
accctactgatgatgtgttgttgccatggtaatcctgctcagtacgagaggaaccgcaggttcagacatttggtgtatgtgcttggctgaggagccaatgg

SEQ ID NO: 41246 - DNA, 318 bp, Homo sapiens
agttcgggatctaaggccctcccctctctaaaatgcaaaatgtgacactgagctaaagatcaaaacacagcaagcgttatctagaaattattcctttaaaaatagtttatttagccatgcaataggataactgtcaaacaatattttatgctacttagagttgtacatataggtacataacattgaatagctttgttgaagtataatgtacctgccacaaaaattcacccatttaaagcgtagtttttagtgtattcacacaattgtgcaacagtgaccacaatctaacttgagaatattttaatcacccccccacct

SEQ ID NO: 41247 - DNA, 263 bp, Homo sapiens
  misc_feature 262, 263: n = A,T,C or G
gaggcaggagaatcacttgagcctgggaggcagaagttgcagtgagttgagattgtaccactgcattccagcctgagtgacagagctagactctgtctcaatcaatcaatcaatcaatcaataaataaataaataaataaaataaatacacactcgaagtaatggatatcccgtttatcctgatcagattattacatgttgtatgtccgtatcaaaatatctaatatagctcgtaaatatatatacctgctatgtagccccnn

SEQ ID NO: 41248 - DNA, 327 bp, Homo sapiens
gaccacgcttttcatctgtcccgctgcgtgttttcctcttgatcgggaactcctgcttctccttgcctcgaaatgggccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttt

SEQ ID NO: 41249 - DNA, 462 bp, Homo sapiens
gctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcacc

SEQ ID NO: 41250 - DNA, 112 bp, Homo sapiens
  misc_feature 104, 112: n = A,T,C or G
gaattttttagaaaacgtgcttcttaatgatatgctattatacttattagttatgtgcaagctttgtatattcttatatttatatataaatataaaaatttgtnaaaggcgn

SEQ ID NO: 41251 - DNA, 324 bp, Homo sapiens; identical to SEQ ID NO: 34051

SEQ ID NO: 41252 - DNA, 260 bp, Homo sapiens
atcccagtaacttcgggagaccaaggcaagtggattgcttgagctcaggagtttgagatcagcctggccagcagggtgaaaccccgtctctacaaaaaatacaaaaattggctgggtgtgttggtgtaggcctgtggtcccagctacttgttgggggcgctgaggaaggaggattgcttgagcttggaaggtcgaagctgcagtcagctgtgtttgcgccactgcacctcagcttgggtgacaacgcgaaccctgtctca

SEQ ID NO: 41253 - DNA, 295 bp, Homo sapiens
  misc_feature 48, 54, 117, 119, 133, 212, 215, 224: n = A,T,C or G
ggggaagttgagacatgtaagaatttgtctcaatattttaatatttgnagatgngattaaaactggaagaatgtggtattagaattacactgattgaatagcaataccatctgctgngngattttttttaagngctttatcacacattaattgtaatcctcacaactgaggtaggtggagcaggagagcatatgacaacccacaaaggatgnggngggacaggngagtttatcctgaggggccagatggcatggagttaggcatattttctccaaagaccttaaaacagattggt

SEQ ID NO: 41254 - DNA, 306 bp, Homo sapiens
  misc_feature 305: n = A,T,C or G
caaagtaactggtggtaggaatcttagaaacaagaccacttatactgtctgtctgaggcagaagataacagcagcatctcgaccagcctctgccttaaaggaaatctttattaatcacgtatggttcacaggataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaant

SEQ ID NO: 41255 - DNA, 267 bp, Homo sapiens
gatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccctttttgtaaaaagtccatttactgtaaaatcgttttttcca

SEQ ID NO: 41256 - DNA, 309 bp, Homo sapiens
atattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctac

SEQ ID NO: 41257 - DNA, 236 bp, Homo sapiens
  misc_feature 235: n = A,T,C or G
aaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatactttttttttatatatatatataaaaataaactttacgtagng

SEQ ID NO: 41258 - DNA, 469 bp, Homo sapiens
agagtagataatatctggaaggaatgactgtttgggaaaagttccaatgctagttcagtgccaacccttccccaccttctccagctctctcccactggttcctcccctctcaactgctctggttcttataaaaacctcacagccttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatacaaataccttcatatcccctcagcagagatggagagctaaagtccaagagaggatccgagaacgctctaagcctgtccacgagctcaatagggaagcctgtgatgactacagactttgcgaacgctacg

SEQ ID NO: 41259 - DNA, 373 bp, Homo sapiens
aggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcct

SEQ ID NO: 41260 - DNA, 468 bp, Homo sapiens
cacataagcccagttcatcaccatttcctcctttacctttagtgcagtttctttccacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaact

SEQ ID NO: 41261 - DNA, 470 bp, Homo sapiens
agcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtc

SEQ ID NO: 41262 - DNA, 422 bp, Homo sapiens
gaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtaggaaattgaccaattaaatgaacaagttacgaaactccagcagcaacttaaaattacaacaga

SEQ ID NO: 41263 - DNA, 202 bp, Homo sapiens
catctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtg

SEQ ID NO: 41264 - DNA, 422 bp, Homo sapiens
  misc_feature 396: n = A,T,C or G
gaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaacctggaaatgagagttccccaagggagaagacaccagaggngactgatgccacttgaggaaatagac

SEQ ID NO: 41265 - DNA, 264 bp, Homo sapiens
acccaccacctatgcagagcttcctgctctcattggcttttctcaccctcactgtcctcttgctgacatccggttgggaccatttgcgcaactgcagactggcagggccaggcaaacacagcatggcgcctgccaagaaggtggtgtgagactgggcacggtggctcgtgcctgtaatcccagcactttgggagactgagatgagtggatcacctgaggtcaggagtttgagaccggcctggccaacgtggcggagccccgtct

SEQ ID NO: 41266 - DNA, 296 bp, Homo sapiens
actgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggt

SEQ ID NO: 41267 - DNA, 129 bp, Homo sapiens
  misc_feature 124, 125: n = A,T,C or G
actgttaacacttttactctttctgttgattcacctaactcattattttgctttattaaaagtcttccttcaccaccgagatatgctaatttaacttacaaatgattttaataaaatcttgagnntgtg

SEQ ID NO: 41268 - DNA, 467 bp, Homo sapiens
attccggggactggagggcagcgccggcagccaagatgcaacttctccaggagtgcttatgttacccaaagagaaacagatgcacaaagagaaggaatgagatgctcggggatattttatcaaggaaaccagcaaaccgtctttttcctgaagaccttttaagattaggacaagcagctgtttataaaagcagaacagtgttaagatttgaactgtaaagtaggatcatgctttgaagtatattctagctaaaagcaggggataaactagataaaacttggagactctaagacctgaccctgattaagtgggcctacaagtgagaatctgaagaacagctctctggctgaacatatcccttggatgttgttattaccagctgcctctagatttgagaacagtgctgagcatgcttttaaatgatctttgaggtactttaagctagctacacctgaaagcatacctag

SEQ ID NO: 41269 - DNA, 181 bp, Homo sapiens
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagagg

SEQ ID NO: 41270 - DNA, 445 bp, Homo sapiens
  misc_feature 159, 348, 408, 411, 419: n = A,T,C or G
ataaaagagagagggcttgtgatgaagatatagtcaaatgtttggttcacatattcttcaaacactgtcacagtgtttgggtgagatggtttgattttcccccttgttccagagtcaatggccgatgtttttgatgttaatccttctatacaggctttnaacagatgtctccccaaattcagatgctctcccaacagtgcatgcacaccccatctcctcccatcttatcatgtaccccagcaaagaaaagaaaggattcttttgattgggcagtgcttagctgtttcatccattaactctttggttttcataccaaacctgtgaagttgtcacctttattttcaaggngtagaaacaggctcggccaggcattacaggtggctcattcctgtaatcccaggattttangangccaaggngggaggattgcttgaagccaggagtt

SEQ ID NO: 41271 - DNA, 376 bp, Homo sapiens
tactttcatttaaagagttgaagactaaggaaactatagtttcctacataaaatctcactgttagcttctgttgatttgcattcagcaaccaggagggaatctctgttgtcctcgcctctggtcagaattctccctgagtactctatctcgttccacgtgcccttccagaaacggatgtgttaaattttggagtatgttttacaaaacagtccccaagatgattaaaggactttaaataaattgtgacaggaagtgagagattattcagtctgaacaaaaaagggtgagtggtgatttaactagaggcttcaaatattagaaagtctctttctgtagtggatcatactcagaagttgttcatcaccccagtcaact

SEQ ID NO: 41272 - DNA, 328 bp, Homo sapiens
gtctccggaaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgt

SEQ ID NO: 41273 - DNA, 298 bp, Homo sapiens
ctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggat

SEQ ID NO: 41274 - DNA, 148 bp, Homo sapiens
gatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgac

SEQ ID NO: 41275 - DNA, 472 bp, Homo sapiens
  misc_feature 469: n = A,T,C or G
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttgggggggtcttgccagcttggggcccctccctgtcgccagtgggcacttttttttttccaccctggctccttcanaca

SEQ ID NO: 41276 - DNA, 355 bp, Homo sapiens
  misc_feature 157, 209, 350, 353: n = A,T,C or G
tcccctcctccccacagtattccctctgcctgactcagctgaggcgagtcagataaccagatggaggtgcagccaggcttgtctggagtgacagatgtgagagcaatagagacatggccctgcccctaaggcctgaggaagggtgtgactcagattnttgagcaagacagaggccctcagtcaccaggaggtgagcccctgtcaccacncttggataaccccgtgggagctgctgggcgcgcacaggacaggtgctccttgagggatgccccgtgcggggggtgggtatgcaaataggaacaagctttgcagagtggacggatgcttgggattattattattattttaanatnat

SEQ ID NO: 41277 - DNA, 218 bp, Homo sapiens
  misc_feature 43: n = A,T,C or G
caaactaagccgattttccggaaaaaggctaaaactacaaagnaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttc

SEQ ID NO: 41278 - DNA, 228 bp, Homo sapiens
gtgggtggatcacctgagctcgggagttcgagaccacccagggcagcgtggtggggccctgtctctattaaaaatacaaaaaaattgactgtgtggtggtgcgcccctgtggtcccgggtatttgggaggctgaggcaggagaaccacttgggccccagaggcgaaggttgcagtgagctgagatcccgccactgcactccagcttgggctacagagtgagactccat

SEQ ID NO: 41279 - DNA, 111 bp, Homo sapiens
  misc_feature 7, 12, 13, 19, 29, 74: n = A,T,C or G
tgtaaanagaannacctgncaacctgganttttttaaaaatacaacactgagccatttgctgcatttctttttntactaaatatgtgactgacaataaaaacaattttgat

SEQ ID NO: 41280 - DNA, 475 bp, Homo sapiens
  misc_feature 184, 281: n = A,T,C or G
cgatccgccatctgcggtggagcccgccaccaaaatgcagattttcgtgaaaaacccttacggggaagaccatcaccctcgaggttgaaccctcggatacgatagaaaatgtaaaggccaagatccaggataaggaaggaattcctcctgatcagcagagactgatctttgctggcaagcagcntggaagatggacgtactttgtctgactacaatattcaaaaggagtctactcttcatcttgtgttgagacttcgtgggtggtgctaagaaaaggaagnaagaagtcttacaccactcccaagaagaataagcacaagagaaagaaggttaagctggctgtcctgaaatattataaaggggggatgaagaatggcaaaaattagtcgccttcgtcgagagtgcccttctgatgaatgtggtgctgggggtgtttatggcaagtcactttgacagacattattgtggcaaaatg

SEQ ID NO: 41281 - DNA, 472 bp, Homo sapiens
  misc_feature 408, 409, 431, 453: n = A,T,C or G
ataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttcaatttatttattgtcttcctgtaagaccttcgggtcaaggcagaggcagggaactaactggtgtgagtcaaatgccccctgagtgactgcccccagcccaggccagaagacctcccttcaggtgccgggcgcaggaactgtgtgtgnnctacacaatggtgctattctgngtcaaacacctgtgtatttttnaaaacatcaattgatatta

SEQ ID NO: 41282 - DNA, 291 bp, Homo sapiens
ttgcccttggtctcggggtcgctgtcggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaagcatgaagaatttg

SEQ ID NO: 41283 - DNA, 480 bp, Homo sapiens
agggaaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgttggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaat

SEQ ID NO: 41284 - DNA, 473 bp, Homo sapiens
  misc_feature 17, 23: n = A,T,C or G
cttttggctctctgacngcaccntggcggttggcaagaacaagcgccttacgaaaggcggcaaaaagggagccaagaagaaagtggttgatccattttctaagaaagattggtatgatgtgaaagcacctgctatgttcaatataagaaatattgggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaagaatggcagacaatgattgaagctcacgttgatgtcaagactaccgatggttacttgcttcgtctgttctgtgttgggttttactaaaaaacgcaacaatcagat

SEQ ID NO: 41285 - DNA, 264 bp, Homo sapiens
attcttgaaaattttttacctgccttttcttcgaacttttgaactgatttcttgcttttctttatctttcttgatcttttcttcatggattcaaaaggaaaaggtatagtaagtaattttagtttgcatgaatggtttcttttggtctttttaatgttggaagagaatgctaccaattatagtcaatgtcctcttacgaaatgcttattgaaaaaaacccagctaattgaaaaattagttaagtgggaaattgtgaaaaaaact

SEQ ID NO: 41286 - DNA, 454 bp, Homo sapiens
  misc_feature 197, 285, 371, 452: n = A,T,C or G
gttgtcatcacattatatgctacaccatcccaaacctcactgccacattacaggaagcatttatgtttgcattcatggatctttgagtcagctgggttttggctgatagaggctgccacaggcgccttagcaagtcttgaggccaacgccagattcaaggaatagagttcatcctacaaagaaaccatggcaagggngcagatacataattctgctaaagtagagtgaagaatctgtcttgggctaaaaatggaaaattcaggaaatgaacgtttacagccttanaagcacctctaagttacgcaaattactcagaagcagatgaattcttttaaaaagttaaattttacttagactgatatagaacgctnttggaaaccaactaataagcatggaaaattgcatccccggaaggcagattgggttaaaatagatgttaatctgggattgtnga

SEQ ID NO: 41287 - DNA, 354 bp, Homo sapiens
  misc_feature 7, 21, 36: n = A,T,C or G
aagcatntaaggtggacagcnaaacagaagctttanttcgagaacaggtgaatcagttgaatttgtgtgtaaaccggggatatcgtctttcactcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaact

SEQ ID NO: 41288 - DNA, 496 bp, Homo sapiens
  misc_feature 1, 13, 26, 57: n = A,T,C or G
ntggcccgggtgnagagtccctgaanttctgccttcctgaacctcaagagtggaganacctgggttgacccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaaagaaggccctgaagctgatggggccaaacgaaggtgaattcaaggctgaaggaaatagcaaattcacctacacagttctggagggattggttgcacgaaacacact

SEQ ID NO: 41289 - DNA, 100 bp, Homo sapiens
  misc_feature 5, 21, 33, 57, 75, 79, 86: n = A,T,C or G
aattnagggtcccttggagangcctcctaaacnaatgtggggctgttaaggttttancccttttgaacctttccnagcnaccttgnagaaaaccctttta

SEQ ID NO: 41290 - DNA, 323 bp, Homo sapiens
  misc_feature 11, 54: n = A,T,C or G
gtagtttttanaatttcctcaaatgaccaatttagttgctgaaatgcaaagacntgaactggttttccttccctttttttcgccctgcaaagaaaactacgtaagttgatattgaagtcagtacaaattgctgagtacaaactttgaaagaaaattaggcaagtggaggatgattcacaagtaacctaattggcaagtccgttaaactcttcacatgagagctccctgttggggagagtggtgtgagtgtgattaatcattcgaacactcctcctttccttagctctgcctgctgctttctctttggcaactgtatttctatt

SEQ ID NO: 41291 - DNA, 421 bp, Homo sapiens
  misc_feature 2, 17, 40, 62, 85, 321, 420: n = A,T,C or G
tnttggcccgggggaantcggcgtttgccgaggctggcantagatttggctgtctccgctcntagctgcttttggcgcgaaagangcccgggtctggttgactcaaaccctgccccgcctgagtctcaggagaagaagccgctgaagccctgctgcgcttgcccggagaccaagaaggcgcgcgatgcgtgtatcatcgagaaagggagaagaaacactgtggacatctaattgaggcccacaaggaatgcatgagagccctaggatttaaaatatgaaatgggtggtctgctgtgtgaataaataattcctgaagaatgnaagaagattaattttggggagttctttgacgaactttgatatgtggaaaaagtatttataattttattgtaagaaagaaagtaaaatattactagtggnc

SEQ ID NO: 41292 - DNA, 384 bp, Homo sapiens
  misc_feature 12, 49, 101, 139, 259, 260, 262, 298, 349, 375: n = A,T,C or G
gagccgcggccncagtctcgggagacatggcgggcgttaaagctctcgnggcattatccttcagtggggctattggactgacttttcttatgctgggatgngccttagaggattatggcgtttactggcccttattcgncctgattttccacgccatctcccccatcccccatttcattgccaaaagagtcacctatgactcagatgcaaccagtagtgcctgtcgggaactggcatatttcttcactactggaattgnngnttctgcctttggatttcctgttattcttgctcgtgnggctgtgatcaaatggggagcctgcggccttgtgttggcaggcaatgcagncattttccttacaattaaggggtttnccttatatt

SEQ ID NO: 41293 - DNA, 436 bp, Homo sapiens
gactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgt

SEQ ID NO: 41294 - DNA, 124 bp, Homo sapiens
  misc_feature 3: n = A,T,C or G
tcnaataaatggctgggtgttttgctctgtttttaccacagctgtgccttgagaactaaaagctgtttaggaaacctaagtcagcagaaattaactgattaatttcccttatgttgaggcatac

SEQ ID NO: 41295 - DNA, 464 bp, Homo sapiens
cgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaag

SEQ ID NO: 41296 - DNA, 129 bp, Homo sapiens
  misc_feature 24, 34, 46, 52, 55, 76, 82, 115: n = A,T,C or G
tgaggagccattttgagcaatggngaacgctcanggtctgtgtggnaatganagntccaaacaccaagcgctccangggctntgggtttgtcacatatgccactgtggaggaggnggatgcatgctatg

SEQ ID NO: 41297 - DNA, 330 bp, Homo sapiens
gcagctgcatccttgcccattgacggtgagattatattggcaactttgaaaaaccaaatattattgaaatactgacccattttccctttacaataacatctttggctgggataattttacccacctataattctcgaagaaaaatgacttcaattatgtcacaaaatttaaaaaatcttaggattggaagagacattaaagagcaattccgagcctagcacagtggctcattcttgtaatcccagcactttgagaggccaaggcaggctaatttgcttgaggctgggagctcaagaccagcctgggcaacatagcaagaccctgtctcta

SEQ ID NO: 41298 - DNA, 271 bp, Homo sapiens
  misc_feature 6, 27, 38, 54, 56, 63, 70: n = A,T,C or G
tcggcntttatggcccgggaggaaaancgtctttggcnaaaagttaataggatnanttaaatnaagttantcttacttaaagaaatgtgtttaatgtaaatgaaaaatcaaaataggctgggcatggtagctcatgcctgtaaatgcccagcactttgggaggccaaggtgggaggatcacttgagcccaggagattgaggctacagtgagccatgatcacattattgcactgtagcctgggtgacagtgcaagacgctgtctcaaaaagc

SEQ ID NO: 41299 - DNA, 500 bp, Homo sapiens
  misc_feature 6, 15, 28, 46, 65, 69: n = A,T,C or G
actcgngcatgcttntgcatgcggctcnactgtcgagctcacttgncctatttcgcgcctatagnggancagtgtaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttggagaattagagagtgagggtaacaagctgtcctctgagctaaagaatgccaaagaggagatcaatgtacttcatggtcgcctggagaagctgaatcttgtaaatatgaac

SEQ ID NO: 41300 - DNA, 357 bp, Homo sapiens
gactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggtctcctgagaact

SEQ ID NO: 41301 - DNA, 150 bp, Homo sapiens
  misc_feature 46, 76, 79, 134: n = A,T,C or G
gtgacgtaagtgtctggagacattgaagctaagatcccagtgcttnaattcaggctctctcatgccaacttacagnggnctgaacagccagtgttttatctaaacttttattaagtaccttagctgaagccctnatagaattataaccat

SEQ ID NO: 41302 - DNA, 469 bp, Homo sapiens
  misc_feature 20: n = A,T,C or G
ctgcccctttctttttttcnggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatggtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtc

SEQ ID NO: 41303 - DNA, 469 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaaatctctttttttctggaggctggcacctgattttgtatccccctgtagcagcattactgaaatacataggcttat

SEQ ID NO: 41304 - DNA, 426 bp, Homo sapiens
  misc_feature 15, 319, 386, 390: n = A,T,C or G
aattcttcccatttnaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtggaggggcaaggctgccccctgccccagggctcttcanaaagcatctgcatgtgaacaccatcatgcctttataaaggatccttattacaggaaaagcatggagngggnggctaacctgaccaataaagttattttattgattgc

SEQ ID NO: 41305 - DNA, 447 bp, Homo sapiens
  misc_feature 26: n = A,T,C or G
gagcacggttcgtttttcctttagtnggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgagggagatgaaggaaggctggtatcctttcagagtgtaaagtaatcttggaatataaaagaatttcttcaggttgaattcctaagaagtttgtcactgacttgtgttcctgaactatgacacatgaatatgtgggctaagaaatagttcctcttgataaataaacaattaacaaatgctttgg

SEQ ID NO: 41306 - DNA, 464 bp, Homo sapiens
  misc_feature 29, 420: n = A,T,C or G
gtcagcataattcttgctctttaattttntcttaatgttttaagcccagactgttatgttctgttttcttaaatgatggttgtagaggaaaagagtaatgcatataaatttccaaatctactatcttaggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatatttggatttgccaaatgaacaagcaagattagacatactgaaaatccatgcaggtcccattacaaagcatggtgaatagaagtcttagtttttggatattaatanttggggggaaagttaacagagctgatgtctagctgatcaaactc

SEQ ID NO: 41307 - DNA, 229 bp, Homo sapiens
  misc_feature 42, 102, 170, 204: n = A,T,C or G
gacccatctctacaaaaagaaaaaagaaaaaaaaaaactgtnttgctaaaatatcatcatcatcatctgagtcttcagcaagttgcaatatttttgctgaanagtcttgcctcagtgttgatggctgttgacttatcaggatagttgttgctaaaggttggggaagctgngataatttctgaaaataagacaacaatgaagttngccacatcagttaactcttcctttc

SEQ ID NO: 41308 - DNA, 469 bp, Homo sapiens
aggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaacttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttgggaaaagataaacatgtcttggttcaaaagttaatacctcaggatggaatcaagaagcagtagacttaccagttt

SEQ ID NO: 41309 - DNA, 485 bp, Homo sapiens
tcaaatgaaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacatttggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttttaccaattccaatttcaaaatgtctcaatggtgctataataaataaact

SEQ ID NO: 41310 - DNA, 242 bp, Homo sapiens
  misc_feature 18, 190: n = A,T,C or G
ataaactggaagctccgnactccgctcccctcccctccccgcccttcgagttgtcctgcctttctggacagaaccaatgtatttcttaaatgtacttgaagtctcatgtctccctaaaatgtataaaacccagctgctccctgaccaccttgggtacatgttttcagggtctcctgagggctgtgtcatngggctatagtcactcaaatttggcttagaataaatctctccaaatattttac

SEQ ID NO: 41311 - DNA, 273 bp, Homo sapiens
gcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactac

SEQ ID NO: 41312 - DNA, 471 bp, Homo sapiens
  misc_feature 157, 452: n = A,T,C or G
aactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattangggaaagaaagtagccttctttttatagcaagagtaaaaaagtctcaaagtcgtcaaataagagcaagagttggtagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattattctaataaaaaaatatgngacttcctttttcttttag

SEQ ID NO: 41313 - DNA, 351 bp, Homo sapiens
gtgagagaactgcctgagtgtaggagatcaccaccaacctggtcaacatagtgacactttgtctctactaaaaattaaaataaaaaaaatgagctacacgttgcagtgcacacctgtagtccgagctactggggaggctgagactggaggatcgcttgagtctagaaggttgaggctgcagtaagctatgatcacaccattgcactttagctttgctaagagcaagactgcatttcttaaacaaaataaaaattagatgggaatattgctcaagccctggaggttgaggctgcagttaactgtgattgcaccactgcagtccagcctaggtgatagagcaagaccctttct

SEQ ID NO: 41314 - DNA, 472 bp, Homo sapiens
gctctttccctaagcgcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtgggagttggcaggtgtgcgcaggccaagcaatggggctggacacaaggtcggtggcccaaaaagagtgctgaatttttgctgcacatgcttaaaaacgcagagagtaatgctgaacttaagggtttagatgtaagattctctggtcattgagcatatccaagtgaacaaagcacctaagatgcgccgccggacctacagagctcatggtcggattaacccatacatgagctctccctgccac

SEQ ID NO: 41315 - DNA, 364 bp, Homo sapiens
  misc_feature 8, 27: n = A,T,C or G
acgaaganaccattggttttctcagangaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaactttggttgttcattagaccctcctggagtatttgttaaaatacagattcacattcagtagagctggggtaaggcctaggaatctgcattttcaacaaccattgcacatgtttttgtttttgttggagaaaggagttctgcactccagcctgggcaacagagcgagactctgtctc

SEQ ID NO: 41316 - DNA, 448 bp, Homo sapiens
agtacttcagctatttttaatagctgaagtaaatggggttcaggcaattcataaaatgcctgaattggtaggcaatgttttatatttgttttttgcttggaagaggaatcttcatcagagttggaaaagtatccttgcccatctcccttagaaaaagttcagaactacttagctagcaggattgctaaagcttgctgcttgtctccttaacatatagatgaaaatgaacattttaaagaacatcttactgttttgtccataggatggccagtgcaatccaaagactatactttccataaagacttttggcagtgtagataaactggaagaaggcacagtgctttagcatgccatctcttctcaaaatctaaggccacctttcttttgaacaccatgctgtcttgcctcctggcccccagtcttttcacccttttccctctgaattagc

SEQ ID NO: 41317 - DNA, 453 bp, Homo sapiens
ggagaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatggggcttttcttgtggaacgcggtcttgactctgttcgtcacttctttgattggggctttgatccctgaaccagaagtgaaaattgaagttctccagaagccattcatctgccatcgcaagaccaaaggaggggatttgatggttggtccactatgaaggctacttagaaaaggacggctccttatttcactccactcacaaacataacaatgggtcagcccatttggtttaccctgggcatcctggaggctctcaaaggttgggaccagggcttgaaaggaatgtgtgt

SEQ ID NO: 41318 - DNA, 189 bp, Homo sapiens
  misc_feature 2, 30, 60, 79, 118, 126, 172, 181: n = A,T,C or G
gntgatcttccggacctatggatagatcangaggcatcactgaggccaggagctctgccnatgacctgtatcccacgtnctccaacttccattcctcgccctgcccccggagccgagncctgtatnagccctttatcctcacacgcttttctacaatggcattcaataaagngcacgtgtntctggtgc

SEQ ID NO: 41319 - DNA, 472 bp, Homo sapiens
catactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataata

SEQ ID NO: 41320 - DNA, 473 bp, Homo sapiens
agggactgcgctgcgtctggaaaagcttcctcctcgatgcctacaaacaggtgaaattgggtgaggatgcccccaattccagtgtggtgcatgtctccagtgcagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagctttctggagcgtttctccttgccgccccagtgccgagttgtggctgaccgcat

SEQ ID NO: 41321 - DNA, 315 bp, Homo sapiens
tgtgaaatacacctagagccttctccgaacaaagaccttcctaggaccttatcctagctgggggaaagtcatttctcccactggagcaagccccttgagtctcctaggctcacatgagggagaaataaaaattcatagtcaacaagaatcaagactttagggaaatacatctggaatgctatatccagggaggggaatagggaagcagggagggggaaaaactattccactagagacacccttaagagagtcacagcctaaagatacagacctactaaatactaaagactaagaaacttctaatatttgaaatgc

SEQ ID NO: 41322 - DNA, 204 bp, Homo sapiens
agtttgagaccagcctggccaacattgtgaaaccccgtatctactaaaatacaaaaattagccaggcgtggtggtgtgtgcctgtaatttcagctacttgggaggctgaggtaggagaattgattgaacctgggagttggaggttgcaagtgagccaagatcgtgccactgtactccagcctgggcgacagagcaagactctgt

SEQ ID NO: 41323 - DNA, 464 bp, Homo sapiens
aatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtaccgggaaggcgaagaaaagaatagagaagatagggaaatttagaagataaaaacatacttttagaagaaaaaagataaatttaaacctgaaaagtaggaagcagaagaaaaaagacaagctaggaaacaaaaagctaagggcaaaatgtacaaacttagaagaaaatttggaagatagaaacaagatagaaaatgaaaatattgtcaagagtttcagatagaaaatgaaaaacaagctaagacaagtattggggga

SEQ ID NO: 41324 - DNA, 464 bp, Homo sapiens
cattggagtaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcaggtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatctttgttgacaagatttgcctctgcacagtttcccaatggtcctcagtttgcagaagac

SEQ ID NO: 41325 - DNA, 157 bp, Homo sapiens
  misc_feature 19, 67: n = A,T,C or G
acagtgtggccgagcaganggctatgtgctagagggcaaagagttggagttctatcttaggaaaatnaaggcccgcaaaggcaaataaatccttgttttgtcttcacccatgtaataaaggtgtttattagttttgttcccacatttatgttgcctg

SEQ ID NO: 41326 - DNA, 236 bp, Homo sapiens
gctttaaaatatccttagaaacaaatatttgaagcttttacttaatagtgattaccttgaactgtgcatttctagtttgtaatacgtatttggttggttcgtgcctttagtttgttaaagttacatttgtattatattcaggaaatgcactttttattacttacagctgtggttttaatactgccttgaactattattattctttttacaactcctaaagcttgagggaggaaaga

SEQ ID NO: 41327 - DNA, 472 bp, Homo sapiens
atttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctccgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagt

SEQ ID NO: 41328 - DNA, 469 bp, Homo sapiens
  misc_feature 140: n = A,T,C or G
agctattgtttggatgtttagtttccttttcttaccccacttttatcatgagaggtgctgagcatgcacaatgctacatgcaaacccttacaccaccacctgtgttactgcagagtaattgaaaattgctgtggtaactngatgcagcaccaaagcctgatggtgagaaacgatgttagtagaaaaatcctactgcctctgaagagcagtggccaagcttcctcaaactgcagccacagttcctaaccaaagaatgggctgcataggatcctggtgtgtagaagactccagttgttacctcagtcttttgagtcttgtatttatgcccgttgggaagcagagccatcaacagcaatatctttgaagagacagaacagtaatcaccattctttggccctacatgttgtacccttgtctcacccattttatctctagtgtcacataaaaggcagacagaggtgctgtgtct

SEQ ID NO: 41329 - DNA, 472 bp, Homo sapiens
  misc_feature 339: n = A,T,C or G
gatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatcttcggtgttctatttattttatttgncttccctgtaagaccttcgggtcaaaggcagaggcaggaaactaactggtgtgagtcaaatgccccctgagtgactgcccccagcccaggccagaagacctcccttcaggtgccgggcgcaggaactgtggtg

SEQ ID NO: 41330 - DNA, 294 bp, Homo sapiens
aaattaaaaagaaagaaatttgaaaaaactttctctttgccatttcttcttcttcttttttaactgaaagctgaatccttccatttcttctgcacatctacttgcttaaattgtgggcaaaagagaaaaaggaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacattg

SEQ ID NO: 41331 - DNA, 469 bp, Homo sapiens
  misc_feature 468: n = A,T,C or G
cagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccactttcttccgcgaattggccgaggagaagcgcgagggctacgagcgtctcctgaagatgcaaaaccagcgtggcggccgcgctctcttccaggacatcaagaagccagctgaagatgaagng

SEQ ID NO: 41332 - DNA, 331 bp, Homo sapiens
agctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatctcagctacttgagaggccgaggtgggaggatcacttgattccagaggcagggcttggttgcagtaagcagagatcacgtctctgcactccagcctggctgacagagtaagaccgtgtttcac

SEQ ID NO: 41333 - DNA, 356 bp, Homo sapiens
  misc_feature 356: n = A,T,C or G
tacagtggctcatgcccattatcccggcactttgggaggccgaggtgggcagatcacctgaggtcaggagttcaagaccagtctggccaacatgatgaaacccggtctctactaaaaatacaaaaattagccgggcatgatggtgggcgcctgtaaccccagctactcaggagagtgaggcaggagaatcccttgaacccaggagacggaagttgcagtgagccgagatcgcatcactggactccagcctcagcgagaacagcattgaatttccctttgtatgaactgtcttttcatgtcctttagccattctctcttcaattgtttctatgggttttttttttctttgaaagggn

SEQ ID NO: 41334 - DNA, 335 bp, Homo sapiens
  misc_feature 17: n = A,T,C or G
atcttctgagtctaacngcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaag

SEQ ID NO: 41335 - DNA, 270 bp, Homo sapiens
  misc_feature 269: n = A,T,C or G
gtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgant

SEQ ID NO: 41336 - DNA, 353 bp, Homo sapiens
aaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttagggaaagggaaatttctgttacttcgggtcagttattttcgggccagacctttttcttgctcctttgccaaaataacttcagtcacgacctg

SEQ ID NO: 41337 - DNA, 347 bp, Homo sapiens
aaccaaaaaagcagtgcctgctttcatatatcacaagctcaaagaacatctgggaaattcatcccaaaaaaataattgcctaggcacattgtcatcaagttcgtctaaaattaagatgaaggaaagaatcttaagagccatgagacaaaagcaccagaaaacctataaaggaaaacctatcagattaacagcagatttctcaccagaaactctacaagctagaagggattggggccctatctttatcctccttaaacaaaacaattatcagccaagaattttgtatccagtgagctgaggtcatgccacctgtactccagcctgggcgacagagggagactccattt

SEQ ID NO: 41338 - DNA, 169 bp, Homo sapiens
aagaacaatgtgaatgaaatcttagcaacttggttagtaatctgaaaagtctattaatgtatacttgaaattctgtttgtataaaaatgcattttcccctttattttaacactgtgtaaaagaacattatgcatgtgagtggtttgagaattaaatggtttaatactcg

SEQ ID NO: 41339 - DNA, 471 bp, Homo sapiens
cttcctgacaacaccgaccgataaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagcctt

SEQ ID NO: 41340 - DNA, 343 bp, Homo sapiens
gatttaggaaagtcctaaatcggatgctgagatcattcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcagc

SEQ ID NO: 41341 - DNA, 471 bp, Homo sapiens
ctgtaaataagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttattga

SEQ ID NO: 41342 - DNA, 453 bp, Homo sapiens
  misc_feature 369, 422: n = A,T,C or G
atgggcttttagaatagtccagtcaagactgctaaggagcctgtgacctgtttaaatagtaacatccggaaggaacaaacaagagaggtgtctgtttaggcatgttttagtgattgattggatgtggaaggtgaggaagaaggggagtcatgaatgactgtaaggttccttacttgtttcttatcaataactaccagaattaaatagcatagacaaccaattggtgccaaacagtatttaattttgtgaatttttattctccttttttttttctgctggagtagggttatttcctttttagagggaaatgaatgatggagatacgacattaattaacttgcatggatccatgatcctgcttctccctanaggaagcacagttattccccaactaacttttaaatgctaattgagtaattagnagattggaaaagagacactgtctttaggaga

SEQ ID NO: 41343 - DNA, 470 bp, Homo sapiens
ctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggcttgtggggctcgtac

SEQ ID NO: 41344 - DNA, 331 bp, Homo sapiens
ataatggaatctatgtttttccttatgtctgtaaaaattggctatagctggccaggcatggtggctcacacctgtaaacccagcactttgggaagccaaggctggagaatcacatgagcccaagagttcaaaaccagcctgggcaacttagagaccatctctacaaaaaataaattagccaggtgtaatgttacatgccagtagtcccagctactccagaggctgttgttagaagatcacttgaaccctagagttcaaggttgcagtgaactatgattacaccactgcattccagcctggctgacagaccaagacccccatctctttaaga

SEQ ID NO: 41345 - DNA, 465 bp, Homo sapiens
caaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcgggggggaaaaagctacttgacttggagggaaagcgtatgtattagcccggcagcctgttggttcccacttat

SEQ ID NO: 41346 - DNA, 471 bp, Homo sapiens
gctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtggtgagtcttttcagcaacccggtccagtactgggagatacagccatccaccttcagatgtgtctacgtgcgctc

SEQ ID NO: 41347 - DNA, 372 bp, Homo sapiens
  misc_feature 17, 20, 44, 48, 90: n = A,T,C or G
ccccgggacctcggcanctncggcccggggtgactggactgganctcnttacaaacccctacccctacctgtggaggaaggattgtaaanaaaaatgccctttgagacagtttctttagctttttacttgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacattttatgatttaataaaataattctaaagg

SEQ ID NO: 41348 - DNA, 453 bp, Homo sapiens
  misc_feature 180, 321, 443: n = A,T,C or G
ttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatanaaaaagtggagttggagaatcggttgttctttcctcacatttggatgattgtcataaggtttttagcatgttcctccttttcttcaccctccccttttttcttctattaatcaagagaaacttcaaagttaatgggatggncggatctcacaggctgagaactcgttcacctccaagcatttcatgaaaaagctgcttcttattaatcatacaaactctcaccatgatgtgaagagtttcacaaatccttcaaaataaaaagnaatgacttag

SEQ ID NO: 41349 - DNA, 340 bp, Homo sapiens
  misc_feature 6, 7, 27, 59, 76: n = A,T,C or G
tcggcnntctattggcccgggaaaggnagcctgcttgcagcagcggcacttacaagccnaaatcagatgaagacgngcggcggttgcaggcaagaaagccctgtggtaggtaaagaaaaggaaagaaaggctgctgttggtgttaagaaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggc

SEQ ID NO: 41350 - DNA, 348 bp, Homo sapiens
  misc_feature 14: n = A,T,C or G
gtccaaaacagagntttagaccaatggaacagaacagagccctcagaaataatgccacgtatctacaaccctctgatctttgacaaacctgagaaaaacaagcaatgaggaaaggattccctactgaataaatggtgctgggaaaactggctagccatatgcagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagcc

SEQ ID NO: 41351 - DNA, 481 bp, Homo sapiens
  misc_feature 461, 463: n = A,T,C or G
actttttctgtacttactaggttaaggcagatttactttttactgatttgtttaggaattatttgattttataatggtaattttcatgatgataatgtttttggttatttggaaagatagtttagagatgaaaggtttttttgggtaacaactcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaaggtngngggtcttattgaaacagt

SEQ ID NO: 41352 - DNA, 500 bp, Homo sapiens
  misc_feature 3, 17, 29, 49, 50, 460, 463: n = A,T,C or G
aancttgttttgtaacntttgttagaganggagtttcgctgtgttggcnntgctggtcccgaactcctggccctcaagtgatctgcccgccttggccctcccaaaatgctgggattacaggtgtgagcccaccatgcccggcctaggctttcaatgaatatcacattggcattatctattgcctgcctactatttcctaaggtgcaggggtaggggtaaacactgatgtaaaaatgaatatcatctgaccctggcctgaaggacctcagagaataatggtgagtcaaatatgaaacaaatctttataagtagggggacaggggctcatgtctataatcccagtactttgggaggctgaggcaggaggtttactagaggccaataattcaggaccagcctgggcaatatattgagtcccatctctacaaaaaatttaaaaatcacccaagtgtgggggggnggngggcatataccctgcagtccttagctacttgggagac

SEQ ID NO: 41353 - DNA, 494 bp, Homo sapiens
  misc_feature 3, 9, 34, 81, 470: n = A,T,C or G
aancaaacntagttttggtgcctaattctgtaanactgttttcttgaaattagattcctttctctaatgtgagaaaaatantatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggaagagaagataaggtttatggcaggtaattttttgtaatgtgtattaaacgaagttcaaagattagaaatacatctgtgtcctgaaaaccttagatacatagccgactgtatacagaggttcatctcaacctcaacactattgacttttgnggctggatagttctctgttgtggg

SEQ ID NO: 41354 - DNA, 497 bp, Homo sapiens
  misc_feature 14, 70, 82, 101, 350: n = A,T,C or G
ctccggcccggganctgagtgtgaggttgaggtgggaccctttgctgagcaaggagaacccgatgtgaantggtaggcaganaaccctgccccccctgaangctggctgggtgtaaggcagtagcggggagcagcatgctgtctaacagctgttagcctccagctggttgttgccatgtgggaatggattttctcatttcttcagagaagctggaaacctagatatttatgtgaaaacctcccagtgtattgccaactaaatcaaatttttaaagatgcttaggcacctaagcaaataatacttagaggttgaatttggtctacaggctagcagtttgcagtctatgttnatgaatggtttagaaaggttggggggaaaggtgccatcttgaaaattctggatcagtggttggcattttcgctgcgtgtagtatgtatcctttctaggcttggagatggctttggttggtccgtgaatgtagttatgaaaaatgctg

SEQ ID NO: 41355 - DNA, 258 bp, Homo sapiens
  misc_feature 7, 43, 56, 58, 67: n = A,T,C or G
cagcccntttgagaggccaaggtgggtggataaccctgaggcnaggagtttgagancnagcttggcnaacatggtgaaaccctgtattctgtgaaaaacacaaaaattagctgggtgtggtggtgcacatctgtagtcccaagctacctcgggtggctgagacaagagaatcacttgaacccaggagggggaggttgcaagtgagccgaggttgcaccactgcactccagcctgggaaacagagcagcaagatcctgc

SEQ ID NO: 41356 - DNA, 471 bp, Homo sapiens
ttggtattctccagaacaagcaggagaagcaagagactgaggaagggagaggtagaattttacacgaaaggttagggaaggtcatagggaggaggtgacattcaagctgagacccgaagggagtgggagcatgagccgtatgatcacacggggaagagtattgcagagagagggaacagcatgtgcaaaggccctttggcaggagctctcctggcactttcaagtaacggcaaggagactgggggctggtgtggagtgaggttaaagctgcaggatgtgagttggaggcatgctggtgaggctgtgttgtagacttctgttaagcaaggataagggcatttccattttatttggcacactgcgggaggagaaccattggaaggttcatagcagatgtgatctgattgaattttttaaagctttcttgaagtataatttacatttgggtggaagttctaaaagaaccatgtt

SEQ ID NO: 41357 - DNA, 170 bp, Homo sapiens
  misc_feature 5, 14, 27, 28, 32, 36, 74, 87, 88, 148, 150, 155: n = A,T,C or G
gtganctgggaganctgtggtctcgannagangtcnttcttgtgtcagaaagtctaagccctcaaggtttctancccttcccttcannttggtggccaagggaaggagcattttcctttggagtgattattgaaatctttttcaagancnaaacnaagcctaggaccctc

SEQ ID NO: 41358 - DNA, 130 bp, Homo sapiens
  misc_feature 5, 6, 28, 45, 47, 68: n = A,T,C or G
cggcnntctatggcccgggggggaaatnagggttcgattccggananggagcctgagaaaggctaccnacattccaaggaaggcagcaggcgcgcaaattacccactcccgacccggggaggtagtgacg

SEQ ID NO: 41359 - DNA, 494 bp, Homo sapiens
  misc_feature 2, 10, 37, 61: n = A,T,C or G
cncgggagangaaaccacgacagttgatcctcgtccnggcccaccagaggccagtcaagangctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgaagagtttccaaagtggacacaggggttattttagaaagaaggagaactaaaggatgatgggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatg

SEQ ID NO: 41360 - DNA, 325 bp, Homo sapiens
  misc_feature 11, 14, 201, 240: n = A,T,C or G
aacgctttttnatnctgtcccgctgcgtgttttcctctttgatcgggaactcctgcttctccttgcctcgaaatggaaccccaactgctcctgctcgcctgttggcttcctgtgcctgtgccggctcctgcaaatgcaaagagtgcaaatgcacctcctgtaagaaagagctgctgctcctgctgccctgtgggctgtgcnaagtgtgcccagggctgcatctgcaaagggacgtcaganaagtgcagcttgctgtgcctgatgccaggacagctgtgctctcagatgtaaatagagcaacctatataaacctggattttttttt

SEQ ID NO: 41361 - DNA, 498 bp, Homo sapiens
  misc_feature 5, 15, 28, 36, 47, 73, 108, 130, 154, 155, 174, 197: n = A,T,C or G
gttcncttggaaccnaaaagggcctgantagcccangtaactcttanacaaaaagtaccaaagcccagagganttaccacttaccccaactttcaaacctctcttacnatctcttacagtagcccaaacnctcactgatacccggtaccaagannccaaagagacccaaggganccagaataaagaaccacagatantaaagcccacacttcctacaccccctgtgatctttgacaaagttgagaaccaacaagtaataggaaaaagggattgtgctgggataacctggttagccatattcagcatattgaaactggacccccttccttttgccgtatacaaaaatcaatttgcattggattaaaagacttaaatgtaagacctaaaactacaaaaaaaaaagaaggtctaggacatacccttctgaatataggcctagaaaaaacttttcatggaaggaagtctccaaaagcaattgaaccaaaaacaaaaataagc

SEQ ID NO: 41362 - DNA, 474 bp, Homo sapiens
  misc_feature 29, 46, 52, 60, 65, 66, 86, 90, 155, 194, 470, 472: n = A,T,C or G
gtttgtgtgaagaccaggcagatgcctgnaccagtgaattgcagangacgcntaccagangtganngtctgtaggtcacacttaantacntgacttgagcagtgggtgacacaacacagtgtttgtcttccacagggaagcttaaaacaaaaganatttttaacccactgacagaacaacaaggttaagcttcntctgcttggtgtcccacagaacttgcacaagcagttgttattggggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttatttttntnta

SEQ ID NO: 41363 - DNA, 471 bp, Homo sapiens
  misc_feature 7, 12, 24, 403: n = A,T,C or G
agtgaantaaantaacctagactnctgttaagtttcctgaagaaggcgtaaaattaatctgaaaataaaagaatcagaataagttattgcttggaaactaagcactatttagacatcttcatttctgaattgtgaggagtttttacaaataccaagtttgtgaaactgtggtcaaaaatagaccaggaaatgccagggggtaaggggtgaaggaagggtttgactgctaaggggccgcacaagggagctgtttggtgtgatgggatggctccatgtcctgattggggtgacggttacacaaatttatacgcaccttcaaactcagaactggataccaaaagcaaagcaaacactgtgaacatgtatatttgggtggttgattgggggattatatatttttggnccagattaactaagcatttaaaattgatgaatttactaatctgggcaacatagtgagaacctgactct

SEQ ID NO: 41364 - DNA, 404 bp, Homo sapiens
  misc_feature 5, 8, 27, 29, 30, 32, 33, 38, 62, 66, 180: n = A,T,C or G
tctcngangaccaactgaccctgtctntnncnntgacnagtgtaactctccttccttttacnaaanttttttagggtttttctcgtaatacttgtacagttttgcatggcctggtgtgatcattttttggttagaatataatgctgacaaatgtggatggaggggaagatactgctttancctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 41365 - DNA, 499 bp, Homo sapiens
  misc_feature 4, 28, 32, 36, 37, 43, 66, 69, 70, 72, 188, 432: n = A,T,C or G
tctnttggcccgggcattggtttcctantaanacannccaaantctagtactctacctcttgtccntcnncntactttgtttgaagctaaagacctcacaatagaatcccatccagcccaccagacagagctctgagttttctagtttggaagaagctattaaataacaacgtctagtgccaattctntacttgttatggtcaagtactgggctcagcattttacattcattgtctctttaagttctagcaatgtgaagcaggaactatgattatattgactacataaatgaagaaattgaggctcagatacattaagtaattctcccagggtcacacagctagaactggcaaagcctgggattgatccatgatcttccagcattgaagaatcataaatgtaaataactgcaaggccttttcctcagaaganctcctggtgcttgcaccaacccactagcacttgttctctacaggggaacatctgtgggcctgggaat

SEQ ID NO: 41366 - DNA, 277 bp, Homo sapiens
  misc_feature 8, 37: n = A,T,C or G
aacctgtnaacactacatggagtgctgccctgatttnaagagagtctgcacctgcggagctttcctgtaaaggcccgctgcttttgagtccttcgagagagggagggagtgtgactgcgacgcccaatgtaagaagtatgacaagtgctctcccgattatgagagtttctgtgcagaagtgcataatcccacatcaccaccatcttcaaagaaagcacctccaccttcaggagcatctcaaaccatcaaatcaacaaccaaacgttcacccaaacca

SEQ ID NO: 41367 - DNA, 293 bp, Homo sapiens
  misc_feature 7, 33, 43, 272: n = A,T,C or G
agcccantaccctgttagaggttctccctttcnctcacctganagctcactaaatgtttcctaaatggttgaacctcaactggttttccttactggatctgttagcttctaatatgggtaggcaaagggacagaaagaaaataaggctgctgctgttataattagtgttgactcatattagaccttgataggtgtatcttaaaaccttaaaaacagattaaattgggctattaaagtatctatgtctgtggtgggggggcaagggggttagntaagtaaggtgttagaggaga

SEQ ID NO: 41368 - DNA, 161 bp, Homo sapiens
  misc_feature 38: n = A,T,C or G
cggccctttattggccgggcaccttaaaacgtaagccnttctcctcactctctcaatcttattccatcatagcaggcagttgaggtggattaaaccaaacccagctacgcaaaatcttagcatactcctcaattacccacataggatgaataatagcagtt

SEQ ID NO: 41369 - DNA, 481 bp, Homo sapiens
  misc_feature 12, 26, 31, 47, 383, 468: n = A,T,C or G
gtggaagaaganctcggctttcctgnagccnttttagtgccgccccntgctaggttctttgaccttgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcaagaccgtgggtcccagcccatttagtaaaatgggaaatcaatttagcanggtggtcaccagcattacacagcaatgaagcagaataaagtaggccagaatgcatcatgtaagtaaaggcaaatactggttttgnggaaacttttcac

SEQ ID NO: 41370 - DNA, 500 bp, Homo sapiens
  misc_feature 4, 18, 30, 31, 44, 52, 65, 81, 86, 95, 106, 110, 111: n = A,T,C or G
ctcnggcccgggggtccntgctggatggcnntcacccgggtgantgcgggcnccgcttgctgtanttgcaaaggttactcnctgangcgagagcntaagccctctntgannggttctaggctgctgagaagaagacaggtattattgccgtttaaaggaggagctgcaacctgtctgatgaacagctacagaaagagatccatttttcctatccatccctccttcagaaatcattgccttggcagaaccccctgttattggaagcacagcacaccagtggctgggaccagaattcttaaccatgttctttttccattacatgaaaccacttgtgaaaagtgaagaaatccaagtgattaaggaaaaaggtcccaaatgtacctcaggaagctctggataagttattatcatttacacacaaactcagagaaacacaggatccaacggcacaatcattagcggcatcactttctaccagacaactgttgcgaatttctcgt

SEQ ID NO: 41371 - DNA, 415 bp, Homo sapiens
  misc_feature 6, 406: n = A,T,C or G
agaganggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggngtgatactt

SEQ ID NO: 41372 - DNA, 118 bp, Homo sapiens
  misc_feature 16, 44, 61, 85: n = A,T,C or G
tctattggcccgggangtgagcctgagtgataaaattggaagcnccaattgatgacacccntcagcaagttccggaggaaaaganagaagaagactctccagaaagatgcagcgacag

SEQ ID NO: 41373 - DNA, 473 bp, Homo sapiens
  misc_feature 37, 90, 358, 444: n = A,T,C or G
atcaccaggtttatctttataccgactttaactgatntgaccctatcttgctacccctggatattttccacattacttgggacaaatggnaagcaacctctgctctccatgatctgttttcacattggttatagcatctcttggatggagtagagggaggtcaacgagaagaagcctacatagatatataactgtcttctctcagattacacattatagcattaaaggttttgattaaaatctaattgtaagatactactgattacaattaccaaaatagcatcacaggagattcaattaaaattgttatggaaataatttttgaaatagtttaaaatgcaagaatattcagcgatgntaataatttagagatactaataagtgttctgctagatagactatttgaaaactataaatgtatttttggattaacaatgccaaggnattttttcatatccacattgaaaaataca

SEQ ID NO: 41374 - DNA, 386 bp, Homo sapiens
  misc_feature 1, 4, 313, 333, 342, 346, 384, 386: n = A,T,C or G
naanaaataatggttttacttttgttttgttttgagataggatctcactctcttgtccaggctggagtgcagtggcatgatcatggctcactgcagccttgacttcctgggctcaagcagtcctcccacctcatcttcccaaggagctaggattacaggcatcaacatcacacccagctaattttttttgtttttttagagatggggtctcactatgttgtccaggccaatcttgaactcttgtgcccttcaaaaaccgaatcctccaaaccctttggggccccttcccccaaagtatttaagggattaccanggcgtaaagccacttggtancccaagctncaanaaaaattattgggggttttggaaacaaaaatggaaggngn

SEQ ID NO: 41375 - DNA, 164 bp, Homo sapiens
  misc_feature 23, 24: n = A,T,C or G
tatggcccgggatccggaaaaanntgtatttgaaaacaccttagtatgcagttgataagaggaatttggtataattatggtgggtgattattttttatactgtatgtgccaaagctttactactgtggaaagacaactgttttaataaaagatttacattccac

SEQ ID NO: 41376 - DNA, 468 bp, Homo sapiens
gagccatacttttttaaggaaaattttgcagggtaaattagcctgtctgggtctgagctctttattcttggatacgttggagatcggaaagatattaagatatggacgttcttactgctcttcttttaggtaaactgtaactttggaatttccccatttctgtagaagtgagtttaattgctccatttatttaattgctttattggttgcttattattatactgtaagaaacagcactaattcataacgcacaggtttcgcttatataccacttatgttctcattcttatcctaaaatatatggacttttttctttaccatttctttttacttatttttgaataccaaattagcatatataattacctttaagtaacatattttgaggcaactaagtataactcggttttctcatgctttaagtaaagaatatagctttgttatctgaaatgatcgtatatcttattt

SEQ ID NO: 41377 - DNA, 206 bp, Homo sapiens
gaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgat

SEQ ID NO: 41378 - DNA, 484 bp, Homo sapiens
  misc_feature 2, 26, 56, 367: n = A,T,C or G
tntggcccgggcttgtgttacagtantgttacctacaacttttaaaagctcagaanttcagatgcttcactttgtttctgaaattccaaattgaccttcagttttttagaaagcagtgcgcttagaggtgaaaaccagaaagcaataacaaaggtgatcatttaagaggttgacagtgacaaaataaaacgctgataggctttttaggtccttagagaagtgggtacatcctatcttattgctgggacttgcactttcttctgtacctttgtgagattggttcaatgaaaggagtgctgatacccaatttcacttcctagtatataagaaatgatgtaattctaaggattcagaagttttggttttncgtttttcataatttctgcagtcaaatgctctaccactgagttataaccccctttttcataatctctgaagtaaagaaatatggatagaataattaaagggttaaaatatcctaata

SEQ ID NO: 41379 - DNA, 470 bp, Homo sapiens
  misc_feature 8, 378: n = A,T,C or G
agtgagantgggaaaaagaaaactccaccaaaacaacacaataatacaataaaaagaaataagaagaattagaagtgaagagacaaaggtttcactatttttaggtgatataatcatttgcatttaaaagatacaagataaactattataaccaataaaataaactgttgtaacaggattgttataaagtttaccaaaacaagatcagtatataaaaagcactagtgggccaaacgtggtggctcatgcttataatcccagcactctgggaggcagaggcaggtgaattgcttgagtccaggagttcaagaccagcctgggcaacatagcaaaatcccttttctactaaaaatacaaaaaaattagctgggagtgggngttgcattcctatagtcccagttactcaccaggctgaggtgggggaggatcacctgagcccaaaaggtcaaggatgcagtgagctgagatcg

SEQ ID NO: 41380 - DNA, 231 bp, Homo sapiens
  misc_feature 1: n = A,T,C or G
nacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaag

SEQ ID NO: 41381 - DNA, 419 bp, Homo sapiens
  misc_feature 6, 10, 30: n = A,T,C or G
taaacnaaantgactgaagcacaggaaganggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtattggagcagcaagactgaaactgttgaggagcccatggagggaagaagaagcagccaagaagagaaagaagaatctgatgatgaagctgcagtagagc

SEQ ID NO: 41382 - DNA, 467 bp, Homo sapiens
attcaacagccttcatacacaaaactctcaataaactaggtattgatggaatgtatctcaaaataataagagctatttatgacaaacccacagccaatatcatacttaatgggcaaaaactggaagcattccctttgaaaaccagcacaaaacaaggatgccctctctcaccactcctattcaacatagtatttggaagttctggccagggtaatcaggcaaaagaaagaaataaagggtattcaaattaggaagaggaggaagtcaaattttctctgtttgcaggtgacatgattctctacttataaaaccgcatcatctcagccccaaatctccttaaactgataaacaacttcagcaaagtctcagaatacaaaatcaacatgcaaaaatcacaagcattcctatacaccaattatagacaaacagagagccaaatcctgagtgaactcccattcacaattgct

SEQ ID NO: 41383 - DNA, 251 bp, Homo sapiens
  misc_feature 16, 33, 43, 46, 48, 68, 81: n = A,T,C or G
tctttggcccgggtanctttaaggagactgccnacctgaaaangangnctaagacaagtcagtaaccnacctgagtgcccntttgaaaggtaaaaggctgttcagggtctgtaggatgtgctagaaggtgggagaagcctctagggggatgggagcagagaatagcaaggagactatacctagttgagtctagaaaaagaattaataggatctaaactgggcctgtagcaatgagaagatggaatgatgag

SEQ ID NO: 41384 - DNA, 227 bp, Homo sapiens
  misc_feature 227: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatggggn

SEQ ID NO: 41385 - DNA, 492 bp, Homo sapiens
  misc_feature 2, 15, 31, 443, 466: n = A,T,C or G
antctaggaggagcntaccttgtaccaaatnttttgcacttcaaccagatgacgtgtactactgtggaataaagtacattcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatccctngggtttctttatttatcgactgngtcattgacaaggaaacttacaaact

SEQ ID NO: 41386 - DNA, 472 bp, Homo sapiens
  misc_feature 448: n = A,T,C or G
tgaaaataggagttgtcaatgcatgtctttgttttgtggcgtatcttagtcttttaaaccagggaaaaacaactgggtcttgagtcagtgttggtcagtgaaaacattattcttgtttgtgagcatatgtgaatttgttatttttttgaaaaaaagtcaagttaaactgatatatcttgttatgaagaatatatattattatgaggaatatattcagttaacattggtatattttttaaaagtatgtttgagattatttgttaaaaagtaatccttaaggtcagttgtataagtcaatagaaatatccataggattgtaatgttaaagtgtgtagcacctatgtggcttgagtatttgtaagtttggaataagaaatatgttagtgaaataatagggacttttactgattatatggaatggaggaaatattttgggtattaccgttgngtcatgagaagttcactaatttgt

SEQ ID NO: 41387 - DNA, 488 bp, Homo sapiens
  misc_feature 6, 26, 453: n = A,T,C or G
aagaancggcccttgctgccccaacntggagactttgtacccgtgtcccgttcttagtgctcgaatgtcccaacctgaagctgaagaagccgccctggttgcacatgcccgtcggccatgactgtgtatgctctagtgggtggtgtcttacttcctcatcaccggaggaataatttatgatgttattgttgaacctccaagtgtcggttctatgactgatgaacatgggcatcagaggccagtagctttcttggcctacagagtaaatggacaatatattattgggaaggacttgcatccagcttcctatttacagtgggagggttaaggtttcataatcctggaccgatcgaatgcaccaaatatcccaaaactcaatagattccttcttctgttcattggattcgtctgtgtcctattgaggtttttttcatggctagagtattcatgaanaatgaaactgccgggctatctgatggggttaaaag

SEQ ID NO: 41388 - DNA, 391 bp, Homo sapiens
  misc_feature 22, 238: n = A,T,C or G
agaggtctctactccaactacnaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcnccttaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagt

SEQ ID NO: 41389 - DNA, 487 bp, Homo sapiens
  misc_feature 381, 426, 477: n = A,T,C or G
gaggtatttgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagactttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgnaaggtgacttaaacagcttaaagtttagtttaaaagttggagggngattaaaataatttggaaggcgatcttttaaaaagagattaaaccgaaggngattaaaaga

SEQ ID NO: 41390 - DNA, 209 bp, Homo sapiens
  misc_feature 26, 31, 36, 108, 156, 201: n = A,T,C or G
tctggcccggggaggcatttgaggcnagccnagcgnggggcttcttgcttgagggggcaggcggagcttgaggaaacccgcagataagtttttttctctttgaaaganagagattaatacaactacttaaaaaaatatagtcaataggttactaanatattgcttagcgttaagtttttaacgtaattttaatagcttaanattttaag

SEQ ID NO: 41391 - DNA, 499 bp, Homo sapiens
  misc_feature 2, 273, 389, 413: n = A,T,C or G
tntttggccgggatccccagcctgtggttacagtgcaggcaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaacttcccccatcagttcccccagtacctccaagcaagtagctttccacatttgtcacagaaatnagaggagagatgggtgtttgggagccctttggagaacgccagtctcccaggccccctgcatctatcgagtttgcaatgtcacaacctctctgatcttgtgctcagcatgattcttnattagaagttttattttttttcgngcactctgctaatcatgtggggtgagccagtggaacagcgggagacctgtgctagttttacagattgcctcctaatgacgcggctc

SEQ ID NO: 41392 - DNA, 106 bp, Homo sapiens
  misc_feature 43, 46, 52, 58: n = A,T,C or G
ttttttttttaacataaggaaatttaattataagaggatatgngcngttttngttatngggatattgtttattttagcttattttttaattttattagaattctgg

SEQ ID NO: 41393 - DNA, 122 bp, Homo sapiens
gtcttgaagatctcattgatgtgatgttacattccctttaatctgccaactgtggtcaaagttcataggtgtcagtacatttccattatttgctaaaatcatgcaatctgatgcttctcttt

SEQ ID NO: 41394 - DNA, 469 bp, Homo sapiens
tgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgaccctgtcagggatcacaggggccaggaacctagcagtctcccaggtggtccataaggctgtgcttgatgtatttgaaggagggcacagaagcatctgctgccacagcagtcaaatcaccctcctttctgcattagtggagacaaggaccattgtgcgtttcaaca

SEQ ID NO: 41395 - DNA, 295 bp, Homo sapiens
agagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatgggagtggtcaagtttgtagaaaaactagctctttagatcttttaaaagc

SEQ ID NO: 41396 - DNA, 407 bp, Homo sapiens
aacctagaagtatgtgcagccaaacagtcaagtaaagtcagaataaatacattttcagtcatgtaaggactcagggtaccctttcttggcaggtattttttaaaagcatgtgctattggccaggcacgaaatggcttatgcctgtaatcctagcactttggaaggcaaagacggatggaacatttgaggtcagcatttcgagaccatcctggccaacacggcaaaacctcatccctactaaaaatacaaaaattaggcgggcatagtggcgcatgcctgtagtcccagccacacaggaggctgaggcatgagaatcacttgaaacagggaggcagaggcttgcagtgagccaagatcacaccactgcactccagccttgggtgtcaagaagtgagactctgctcagg

SEQ ID NO: 41397 - DNA, 465 bp, Homo sapiens
tatcctgagcttcgtgagttgagcgctgctgctccgcggtggagtcaccgcaccgctcccgggatcatggtgttctacttcaccagcagcagcgatgaagatctgatcaagcatggctggcctgaagatatctggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaaatagggtggaacttgacagcatataacttaaagtgaaaatgtttttgccagaacatgtcttggtaccttgtgaaagcaggctgcccttgttcttgagatagacttt

SEQ ID NO: 41398 - DNA, 401 bp, Homo sapiens
agcccaaaatttccttatgctgataagcaaattcagcaaagtctcaggatacaaaatcaatgtgcaaaaaacacaagcattcctatacaccaataacagacaaacagagagccaaatcatgagtgaactcccattcacaattgcttcaaagagaataaaatacctaggaatccaacttacaagggatgtgaaggacctcttcaaggagcactacaaaccactgctcaacaaaataaaagaggacacaaacaaatggaaaaacattccatgctcatggataggaagaatcaatattgtggaaaatggccatactgcccaatgtaatttatggattcaatgccatccccatcaagctaccaatgactttcttcacagaattggaaaaacaaaacaacaacaac

SEQ ID NO: 41399 - DNA, 434 bp, Homo sapiens
  misc_feature 8, 11: n = A,T,C or G
ctaaattngtnagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttggttttgatcaaaataaaggatgataat

SEQ ID NO: 41400 - DNA, 141 bp, Homo sapiens
  misc_feature 3, 4: n = A,T,C or G
tanntgttgttattaatgaagaggattaccctggcagtggaaagacacatgttgcaaaacttattcgagataaggaggtagaatttggaggacctgcacccagagttctaagcctggatgattacttcatcactgaagtgc

SEQ ID NO: 41401 - DNA, 469 bp, Homo sapiens
  misc_feature 361, 363, 364, 402: n = A,T,C or G
cattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggaaatggnannaaaagttaattgggattttttttccaggctagtaagangtatcatctaagtaaaaagacttggccacagggaatatctggtccagaatctccagtcatcagagac

SEQ ID NO: 41402 - DNA, 403 bp, Homo sapiens
  misc_feature 2, 9, 29, 204, 339: n = A,T,C or G
anttcggcnttatggccggcacaaaagantgtcagtctctcactgctttatattagctaatctctagacggactttcctggttgaagcttacttttttcatcagtctcttatcaagaatgctctggttaagaactaattcatattacggacatcattaatatatttgtaagtatccataaatataaattttaatattaaatgtnaatagggatattacatgatattggcatactatataatgtgcttatatatatttatttcaaatgttaactgaatcagatctttaaatattttcgtttgtttttatgcaccctgaaacaaaagtttactcctttggntgaaaattcaccttcacaaatattcatattaccaattacctttctcataaaatattaactatca

SEQ ID NO: 41403 - DNA, 179 bp, Homo sapiens
  misc_feature 4: n = A,T,C or G
ctgnaaaggggcatcggaaaagtgcagctgctgtgcctgatgtgggaacagctcttctcccatatgtaaatagaacaacctgcacaacctggatttttttaaaaataaaacactgagccatttgctgcatttctttttatactaaatatgtgactgacaataaaaacaattttgacttt

SEQ ID NO: 41404 - DNA, 471 bp, Homo sapiens
aagtttactcgatataattagtacgacctttagcccattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaaggtactgtttgaatctctttctcagcacctccttctccctggccctcttaact

SEQ ID NO: 41405 - DNA, 138 bp, Homo sapiens
  misc_feature 8: n = A,T,C or G
gacccagnatctgtgtcttgaagcagctgccctcattccgacttcagaaaatcgaagcagctggctcctccccttgttctctctcccaccctcccccaaatctgttttcatgtaaaaggcaaataaatgatgacttcc

SEQ ID NO: 41406 - DNA, 225 bp, Homo sapiens
gagtttcagttcggcatgatggggaggttccagaggtggatggtggtgaacaacagcttgaatgttcttaatgccattaagtgtacactttaaaatggttgacatgggccaggcgtggtggctcacgtctgtcatctcagcagtttgagaggccacgaagggaggatcacttgagcctaggagttcaagaccagcctgggcaacagagagacccctgtctgtacc

SEQ ID NO: 41407 - DNA, 372 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaagcctaccgagcctggtgatagctggttgtccaagatagaatcttagttcaactttaaatttgcccacagaaccctctaaatccccttgtaaatttaactgttagtccaaagaggaacagctctttggacactaggaaaaaaccttg

SEQ ID NO: 41408 - DNA, 230 bp, Homo sapiens
attccaaaatttgaaaatatctgaaatcaaatgcttggtaccggaaggtacttaacctgtagtaatagaactaacactaaagcacagcacaggcaaatacaggtaaggcttctccaacttgccctggagcaatctttgaagtcagttgttgaagctcaggagttttgaggaattctcaaatcattgtaagaatctgcagcctgaccaacatggagaaaccccatctctac

SEQ ID NO: 41409 - DNA, 141 bp, Homo sapiens
aatcaaaactttaggaaataatggacatacttatagaaatataaaatgctctggaaagtcttagcaatagaattgaacaagtagaagaaggaaattcagagcctgaagacaaggtcttctaattaaccgaatccaataaag

SEQ ID NO: 41410 - DNA, 213 bp, Homo sapiens
  misc_feature 13, 211, 212, 213: n = A,T,C or G
caggagtccgagnaccgcctggccagtatggtggaatcttgtctctactaaaaatacaaaaattagccaggcatggtggcgcatgcctgtagtcccagccacttgggaggctgaggcaggagaatagcttgaacctgggaggcagaggttgctaggagctgagattgtgccactgcattctagcctgaagacagacagagactccatcgcnnn

SEQ ID NO: 41411 - DNA, 205 bp, Homo sapiens
tctcttcgaagctgcatcttattctagtgttttttttctcttaaaaaagtaaaacttcctttttttcttttcctaaagtaagcattgtggaagattgccttattttgcatgttcttatctcacatttgattttttcttatctctaatgaaaaataattatgtaattctgaccgtttaattttaccagagcagtaaatgatgggtc

SEQ ID NO: 41412 - DNA, 189 bp, Homo sapiens
aacatagcgagatcctatctctaccaaaaaaatattttttaaattagccaagtgtggtggcacacctgtagccctggctactctggaggctgaagcaagaggatgacatgagcccgggaggtggaggctgcagtgagccatgcttgcgccattatactccagcctgggtgacagagcaagaccttgttt

SEQ ID NO: 41413 - DNA, 413 bp, Homo sapiens
attttacattcccatcaacagtgtacaaatgttccagttttttcaacttcaacattttttaaaggaagacaacaaaatccaaacacttaatagttatccaaaatgaagtacagagtggaataaaagattgaccaaaaaaatgaatgaaactttagtgacctgtggtacaatatcaagagggctaatatacatgggatagagtctcataaagaacaaattgggaatagcagttgaagaaataatgtttaatatttctttcacactttcattaaaactatatcccacagatcgatgaaactctacgaatcccacgtaggataaacacactgacagcatacatagacatattaaaggacattattaccaaatttctggaaaacgattgtaaagagaaaatcttaaaattaaccagc

SEQ ID NO: 41414 - DNA, 469 bp, Homo sapiens
  misc_feature 1, 2, 3, 4, 5, 6, 8, 11, 15, 32, 35, 36, 55, 56, 80, 88,418, 421, 468: n = A,T,C or G
nnnnnngncgncccnggggctatggctcttgnttnnacagcggttggtcggtacnnatccggggactctcttccagcctncgaccgcnctccgatttcctctccgcttgcaacctccgggaccatcttctcggccatctcctgcttctgggacctgccagcaccgtttttgtggttagctcctttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgnggnggccgcgctcttcttccaggacatcaagaagccagctgaagatgagng

SEQ ID NO: 41415 - DNA, 382 bp, Homo sapiens
caactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttg

SEQ ID NO: 41416 - DNA, 156 bp, Homo sapiens
atagtgggggagtaagtagtggagagtagcagtgtattccttagaggaaagccttaattttggcaggaacagaatcctccttaaggaggcccctgagttcacactcttttgggtacttccccatgaagagtataggcattttctgacttctcatta

SEQ ID NO: 41417 - DNA, 187 bp, Homo sapiens
cggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgac

SEQ ID NO: 41418 - DNA, 305 bp, Homo sapiens
  misc_feature 3, 304: n = A,T,C or G
gtnaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtnt

SEQ ID NO: 41419 - DNA, 264 bp, Homo sapiens
ctagttcaggtctcttttttcatcctttcaatggtaaacggcctttttccccctcttctattacatgaaagtcaaacctaaaaggatatttacttatcttgtatctcacacattcatttatgcttgtttaaaaattgaggccaggcgtggtggctcatgcctgtaatcccagcactttgggaggccgaggcaggcagatcacaagatcaggggttcgagaccagcctgactaacatggtgaaaccctgtctctactaaaaatac

SEQ ID NO: 41420 - DNA, 470 bp, Homo sapiens
agcgctttcaacaactaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtaca

SEQ ID NO: 41421 - DNA, 340 bp, Homo sapiens
ccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 41422 - DNA, 465 bp, Homo sapiens
gacaaaaaccaaatgattatctcaatagatgcagaaaaggcctttgatgaaattcaatgttctttcaagttaaaactctcaatagactagatattgacagaacatatctcaaaatagtgagagctatttatgacaaacccacagccaatatcatattgaatgggcaaaagctggaagcattccctttgaagattggtacaaggcaaggatgccctgtctcaccactcctattcaatatagtgttggaagttctggccagggcaatcaggcaagagaaagaaataaagggtattcaaagagagaggaagtcaagttgtctctgtttgcagatgacatgattttgtatttagaaaacccaatcatctgagcccaaaaacttcttgaactgaaatgcaacttcagcaaagtctcagaatacaaaatcaatgtccaaaaatcacaagcactcctttatggtaacagtag

SEQ ID NO: 41423 - DNA, 467 bp, Homo sapiens
  misc_feature 5, 12, 13, 14, 18, 19, 22, 23, 39, 51, 112: n = A,T,C or G
acaangactgannnctgnnggnnagaggatccatgaaanataaactatatnaacactaaacctcgcccaacaaattcagtattttactacatctagactttgctcaagagtntttttggcatcatttctactcagggtttttctacaaattcttactacctttttcacccattgttaggataataaagcacaaagccacttagacaaagcagctgtgttgccggacatacaacttctcataaaaattataactgtacgtattgctgctggtttaagtagtgatgggtttattcttgataatgcaaatcactgattttcactaaccgagcactaattcagtagtagtcaaagtgtggtccttggacctgcagcatctgcataacctgggtacttcttagaaatgcagacttttaaaatcagaaaccctgggagtggaactagcagtcgtttaataggcattccaggtg

SEQ ID NO: 41424 - DNA, 466 bp, Homo sapiens
  misc_feature 7: n = A,T,C or G
aggttangacagaaacataggttaggacagtgttcatataggtttcatggacagaaaacaagggctgaatttggatttcatggtttgtgaaaaatgattggaaaaagtctgtgtaactatcagtgggactacagctcatttaaattttcccacctagggaatgggaagaagtagacatagctcaatggtcaagatctgggccaaaccacgactaactccatgagtggtggagcaagatggagaaaaccactgagctactagacaacaatgggtgagtgctggggagaaaaccaaaccaataagctctcaccccaaatcaggctatgacatcagattctgatatttatcaagaaaactaatgccaagaataatcaccaacatcaaacttcaggagatggatttattccagataaatgaaaaataaaatagaataatctggaaatgaattaaaaataaatctgtcaac

SEQ ID NO: 41425 - DNA, 467 bp, Homo sapiens
  misc_feature 29: n = A,T,C or G
agcggcggtgaaggtcctgggtgaggtanggttggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaaagatgatcctccaaatgtacata

SEQ ID NO: 41426 - DNA, 423 bp, Homo sapiens
cagaggtagttactcctattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataagtatgtct

SEQ ID NO: 41427 - DNA, 389 bp, Homo sapiens
aacattaaaaagattaaacatagtttcaagcttattcatttatattttctctatgcattaaacaataaattttaaaaatcaatattttaactgtcctgattgtcacatcagagagggagaaagtgaagtgggagaaatttttttctgaaagagaaattttagtatttaatatgcttcaacatttcaggcactactaaagaaagaaaagacagcctgggtaacatagtgaggctctgtctctataaaaaataaaaaagtagccaggcacggtggcacacgtctgtaagcccaactgtttgggaggttgaggcaggaggatcccttgagcccaggagttcaaggtagcagtacgttgtgatcataccactgcattctagcctgggcaagat

SEQ ID NO: 41428 - DNA, 477 bp, Homo sapiens
gaactcggtggtggccactgcgcagaccagtacttcgctcgtattcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgtcaacgaaggccgcgcctgcctttcccatctgtctatctatctggctggcagggaaggaaagaacttgcatgttggtgaaggaagaagtggggtggaagaagtggggtgggacgaca

SEQ ID NO: 41429 - DNA, 470 bp, Homo sapiens
  misc_feature 455: n = A,T,C or G
gtcccctgaaggaattcaaaggccaagctgccactgcctgagaggagtgcttcgtgtgtgctgctgatctaagatgtggagcctctggcttcgtatggcactgaaggaaccttggaggttagaatatgttatgcgagatatttaatgagacatatgaacagaacatctgaatcaagccaacagagtatgacatttccaggcacctgagttgggcaatgaatttggcctggtggctagcaaaagtcatgagtagaatggggattgggtgttggtgggtggtttgggccatgcaaaggagtcaggattctgagattttgggtagctgagattgtgacaagagggacttttgaggtcagtgattctagatgggttactttcctggaagccatatgccttgtgtgggcactattactatcaatttctacttaatgaacctctgtatgtggcactttttnggggttcaagttttt

SEQ ID NO: 41430 - DNA, 314 bp, Homo sapiens
caagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactg

SEQ ID NO: 41431 - DNA, 273 bp, Homo sapiens
  misc_feature 40: n = A,T,C or G
atccctgatactgtgtatgctttgaagcaccttccctganaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgatt

SEQ ID NO: 41432 - DNA, 152 bp, Homo sapiens
agctgggtgtggtggcacatgcctgtaatcccaactacttgggaggctgaggcgggaggatcacttgaacccgagaggcggagattgcagtgagccaagattgcgccatcacactctggcctgggcaacaagagtgaaactccgtctcagcg

SEQ ID NO: 41433 - DNA, 339 bp, Homo sapiens
agagtgggctgaactttgggtctaaacgagacaatagctgccttcgcagtatcagcagaatggttgatgggagtgcactctacatttggcagagaatcatgtgaccttacgactgagatcttgtgatggtgccaacggagacttggaaagcagcaaccgtcctgacttttttcttcttttctaacatggctcagaaaatggtggatcttaatacttgactttagccagactcagcaagcgactgagctttgaagcacaacttcgcctttattctgggtttttggcaggccaccaggaggctgtccctttcacgcctgataaattctgctgcttatctca

SEQ ID NO: 41434 - DNA, 476 bp, Homo sapiens
  misc_feature 362, 431: n = A,T,C or G
agttgagcaagcaggttcagttcattgaggcctctttattttcaaagcttttctccaattatcttcattgcattttggccatcaggctgctccatgttctccaaaggttctttgaactttctcccacctctgccttagatttggaagctcacaccaccttcaatgcctttccttcattttctgccagggaattctgcttatcctccaaggcttgactgcagaactctgtagagagaataaaggccttcttagagctctgtggcaatgttccttcttatataactataattatataccaatctgtactgaactgtgattaagagttgactttttctctagtttgaatatatttagttcggtgngcataattgtgcttattcttttgttggtaaatagtcattgaattcaataatggtaaaatgagggctggntgcatatatttgcagaggagctttcaaaggttataatctatacct

SEQ ID NO: 41435 - DNA, 225 bp, Homo sapiens
  misc_feature 20: n = A,T,C or G
tgatagctggttgtccaagnatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaggctcaacacccactacctaaaaaat

SEQ ID NO: 41436 - DNA, 469 bp, Homo sapiens
agggagaagctggcctatggatgtggctttgaagagaagacaggattttggcattccttgctaagcacgttcaatggaggagagccatgaagttttacaaaaataattatggtaaattaaaaggatattagatattggatctcagactagggctgctataatacagttctctgattcgcacaccagatgttctgccagcgaactgttgtctgggcattggaaggagttaggttttttgtgtttgtgaaaatctcctggattagtaaaaaaattttctagatataaagtggttttatttgggctcatgaccattgcccaaagtgtactgagcttttcactaagtgctcagcattggcctcctgttctcatttattcattttatgagatggacttggacatcactaatgcaaacacaggattcataaattattctgaagtttattttagtgccttgcctcaatggagctta

SEQ ID NO: 41437 - DNA, 169 bp, Homo sapiens
atagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaac

SEQ ID NO: 41438 - DNA, 477 bp, Homo sapiens
aatacatttcttatcagaatgttctgataggggctagaggtcatagcaacaaattcaaagtgcctatcctttagtaaccttaagtggattaatgttttagaaaagatagtcaagactgggcacagtggctcacaagccctgtcatcccagcacttcgggaggcctagacaggaggatcacttgaggccaggagttcaaggtcagcctggacaaagtagcctgagacccccgtctctataaaaatatatatattttttaattttaaaagatagtcatgaatacaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatggcaggaggattgcttgaacccaggagttcgagaccagcctgggcaaca

SEQ ID NO: 41439 - DNA, 468 bp, Homo sapiens
aggagccgcaagtaggaaacagctaatcaggaatacaaagtctccagctgtgaacagagtactcatcagtgaaatagagtacaggctacgaaaggtctcctgtggatgaatcacggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcacctacaccattcaaagagatctcgatgggacctgctccctccataccacagcctccaccctagatgatgatgggaattatacaattatggctgcaaaccctcagggccgcatcagttgtacttggacgactaatggtacaggctgtcaaccaaagaggtcggagtc

SEQ ID NO: 41440 - DNA, 251 bp, Homo sapiens
gaaggaaatagcattgaaatgttaaatacaatttctgaaagttatgttttttttctatcatctggtatacccttgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttg

SEQ ID NO: 41441 - DNA, 472 bp, Homo sapiens
  misc_feature 471: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttggaggtgattaaaataatttgaaggcgatcttttaaaaagagattaaaccgaaggng

SEQ ID NO: 41442 - DNA, 376 bp, Homo sapiens
aatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattattgc

SEQ ID NO: 41443 - DNA, 152 bp, Homo sapiens
aaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcgg

SEQ ID NO: 41444 - DNA, 465 bp, Homo sapiens
  misc_feature 5, 29, 52, 58, 59, 78: n = A,T,C or G
cttangaagtctacgcttattaaggaagngacacacccgcctcatcagtcancctganntcctattgctgcctaggtnctcagccacatcctcagcaccattagtacttggtaacatttcctgagtgcttataagtggctagacagtgcactgagtgttccatatgtttattaatttaatgctcacaacaacgctgtgaaacgtgtgctcttttccccatcttataggtgagaaaagcgtggctaagaggtaaaatgtaacttgctgaagttacacagtgagggtatgatggagtcagaacctgagcccaggcggttccatttaagtcttcttttgtctttatactaagagcaagtgattaaacaatgacggagtcttggcttttactctaagggaacagtgtaatgaagggagagattcatatggatagacaaagtactaagattatcagtcctcttcgaagtt

SEQ ID NO: 41445 - DNA, 414 bp, Homo sapiens
  misc_feature 34: n = A,T,C or G
atatttgaagatgagactttggagaggtaattanggttatacgaatttattgagggggagactcatggtgggattaatgctctcttatgaagagtcattaatgccctcttacaaagagtcattgtctctccatctgcatataccatgtgaggacacagcaagaaggtctgtgtcctctgcaagaaggtccatctgcaagtcaggaagagagccctccccagaacctgaccatgctggctccctgatttctgacttccagcctccagaattgtaagagaataaatttctgttgtttaagccatccagtctatgatatttagttatggtagtctgaaaagaccaagatagcaattgaattatatttgaaagtcactcacaaagtttttcagttactgaacttaaattgttcacata

SEQ ID NO: 41446 - DNA, 468 bp, Homo sapiens
  misc_feature 2, 3, 16, 19, 25, 29, 66, 68, 91: n = A,T,C or G
gnnttttggttctctnacnagacancatnttggttggcaagaacaaggcgccttacgaaaggcggngnaaagggagccaagaaataaaagnggttgatccattttctaagaaagattggcatgatgtgaaagcacctgctatgttcaatataagaaatattggaaagacgctcgtcaccaggacccaaggaaccaaaattgcatctgatggtctcaagggtcgtgtgtttgaagtgagtcttgctggatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgc

SEQ ID NO: 41447 - DNA, 209 bp, Homo sapiens
caattgcttgcattattctgtacatttctttttgagggtgcagaagtgggaaggaaggcagggttaggagtgattgaaaataaatgagagaggccgggcgcagtggctcaggcctatattgccagcaccttgggaggctgagtcgggaggatcttttgggcccaggagttcaagaacagcttggggaatatctggagaggcctcctctt

SEQ ID NO: 41448 - DNA, 472 bp, Homo sapiens
attccacagccgatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggatggggagcagctagaacaatgcagattcatccataatccctttctgctgttcaccaccacccatgatccatctgtgtagtttctgaacagtcagcgattct

SEQ ID NO: 41449 - DNA, 450 bp, Homo sapiens
agtttaagaaatgctatttttaaatgaatttgatgcaagtcaaggataacgacattaagatatttttaaacatcttatattacccttagtcacatttgagatatagttgaaataaaggagtgtagctacagtatctagactttggtatttaaaactttcactcaggcctggacatggtggctcacacctataatcccagtattttgggaggctgaggcaggaggatcacttgaggcaaggagttagaggctagcctggacttcatagcaagacctcccctctacaataatatttttaaattaagttccggtgttgaggcacattcctgtagtcccagatactcaggaggcagaggcagaaggatctcttgtgcccaggagcacaaggctgcggtgagctatgattgcaccactgcaccccagcctgggcaacagagcgagaccctgtctt

SEQ ID NO: 41450 - DNA, 467 bp, Homo sapiens
gcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgtttagcaaccttttccacgggatggataagaatactcctgtaagatacacagtgtattgcagcccttattaaagtggcagcatcttgtggggccatccagtacatcccaactg

SEQ ID NO: 41451 - DNA, 313 bp, Homo sapiens
  misc_feature 22, 24: n = A,T,C or G
cgaggagcaaagagaaaaaagnanaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagccct

SEQ ID NO: 41452 - DNA, 469 bp, Homo sapiens
  misc_feature 292: n = A,T,C or G
gtcttctgggaggtcattttcaacttcattaatctatcagcctttaaaacttcttttttaaaaacttataatttacttctccccaaccctccaactttgttttttcagttaagaggaactaatacatacatatttacattgtgtaaacttttgaagaggacacagaagttttcttttttactttcaaacatgactctaaagattttattaaaaggatttttttttctgttttgttttcagacatggctttaaatatttatatctggaaaaccacactgaagttacaattagncagtaataaaaataatgtgtgacatatattcaactacccaaaccatccaacatcccttatcagagttgatgagttgaatcctgaagtttgacgcagggagatcgcaactgtgctgtatctgagtaaactcttaatttagactaattctaagaattaaaaatgggtttaaaaaatcta

SEQ ID NO: 41453 - DNA, 418 bp, Homo sapiens
agagtcttgctctgttgtgcgtttatgtgatcacggctccctgcagcctcggacttccgggctcaagtgatctttccacctcagcctccctggtagctgggactgcgggcatatgccaccacacctggctaattttggtattttttataggaggtagggtctcaccatgttggtgacccaggctggtctcgaactcctgggctcaagtaatcccacactttgggaggccaaggcaggtggatcacttgaggtcaggagtttgagaccagcctggccaacatggtgaaaccccgtctctactaaaataacaaaaatattagccaggcgtggtggcgtgtgcttgtggtcccagctacttgggaggctgaggctggagaatcgcttgagcccgggaggcagaggttgcagtgagccaaga

SEQ ID NO: 41454 - DNA, 184 bp, Homo sapiens
gaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcac

SEQ ID NO: 41455 - DNA, 459 bp, Homo sapiens
  misc_feature 27, 41, 459: n = A,T,C or G
gaacgcagagttgggagcaactccagnagcctccttcaagnatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagn

SEQ ID NO: 41456 - DNA, 377 bp, Homo sapiens
  misc_feature 283, 286, 313: n = A,T,C or G
tggtgcctagagtttggcaagaatgcaatattaacagagcacagaacaagaggaagcttctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagcccaanaancgccccttgactccttttcaccatcgngtgtctgttagtgatgatgttggcatggacgcaaattcagccagccaaagacttgtgatctctg

SEQ ID NO: 41457 - DNA, 130 bp, Homo sapiens
agtaaaagactggttaatgataacaatgcatcgtaaaaccttcagaaggaaaggagaatgttttgtggaccactttggttttcttttttgcgtgtggcagttttaagttattagtttttaaaatcagtac

SEQ ID NO: 41458 - DNA, 464 bp, Homo sapiens
  misc_feature 32, 320, 393, 396, 412, 454: n = A,T,C or G
gagggtaaggttatctgtctgatactgagcanaaacagaatgatcctggagctttgctttctattgaaggcttttgacggtaataagtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatatngtagaataaatattaaaaagcctgttccagagactcccaagcagcctgggcaggcagatgtaccattgttagnggngtatgctcggcctcgnggtccatatattctgcacttttatatttgccaccagaatggnagtttgctgc

SEQ ID NO: 41459 - DNA, 363 bp, Homo sapiens
ctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtg

SEQ ID NO: 41460 - DNA, 477 bp, Homo sapiens
agctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttata

SEQ ID NO: 41461 - DNA, 402 bp, Homo sapiens
  misc_feature 142, 232: n = A,T,C or G
aggccaaggcaggagggtcacttcagcccaggagttaaaggctgccgtgagccgtgatcacacctgtgaatagccaccgcactccaacctgggcaacacaacaaaacctcgtttctaaaaaaaaacaaaggctgagcacggnggcttacacctgaaatgccagcactttgggaggctgaggcgggcaaatcacttgaggtcagaagttcaagaccagcctggccaacatggngaaaccctatctctaccaacataaacattagccgggcgtgcctgtgattccagctgcttgtggggctgaagcacaagaatcgcttgagccccgaaggcagaggttgcagtgagctgagattgcggcactgcgatccagcctgggcaacagagtgagactccatctctaga

SEQ ID NO: 41462 - DNA, 459 bp, Homo sapiens
gtactggacggctaatggtacaggctgtcaaccaaagagtcggagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcacctctctgatcatagagccagtcacgtcacgtgatgccggcatctacacatgtatagctaccaaccgagcaggacagaactcattcagcctggagcttgtggttgctgctaaagaagcacacaaaccccctgtgtttattgaga

SEQ ID NO: 41463 - DNA, 380 bp, Homo sapiens
  misc_feature 141: n = A,T,C or G
aatctcagtcactctaggactctgcactgaatggctgacctgacctgatgtccactcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaaga

SEQ ID NO: 41464 - DNA, 177 bp, Homo sapiens
ttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaaaaaaaaaaaaagg

SEQ ID NO: 41465 - DNA, 473 bp, Homo sapiens
  misc_feature 147, 422: n = A,T,C or G
gtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcangaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagnttaccggtcgctaccattacctggggggtcgttttgtgccacctgctctgg

SEQ ID NO: 41466 - DNA, 467 bp, Homo sapiens
  misc_feature 6, 32, 43, 289, 438: n = A,T,C or G
gacccngtgagtgtgagcatttaagaagcatnctctgccaagnaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttantgcaacttcagcagaattgctctgctgcccaaaagacgttttctttggaccaaagatctctttcgtgattccttgcaacaatcaatgagaatcttcatgtattctggagaacaccattcctgatttcccacaaactgcactacatcagnataactgcatttctagtttctatatagtg

SEQ ID NO: 41467 - DNA, 477 bp, Homo sapiens
attccctgtgaccactgatactcacgaacgatgctcgttagttgggattttgggtttacttccatgcgtacttgtctcctcttgtgttgaggtaattacttttgatgaagaatgacacaacattcttagtattggcatgtgcactcattttaatgaggattttagtcattggttttggggtttaggaattgggttttgggttgatgatttaaatcaagttgaagagggagaactcagttgattccatttcaactgtcgcccaggctggagtgctgtggtgccatcgcagctcaatgcaaccttcgcctcccggtttccagcgggattctcctgcctcagcctcctgaggagctgggattacagatgcgctccaccacaggcggctaatttttgtatttttagtagagacggggtttcaccatgttggccagtctggtctcgaactcctgacctcaggtgatctgcccactttggcct

SEQ ID NO: 41468 - DNA, 280 bp, Homo sapiens
ctaatcctgtggttctcaaacctgagtatatatcagaatcacctggagtgcttgttaaaacacagatgctggagctctccctagaagttctagtttagtctatggtagggcctaagaatttgttttctaaggtctgcaggtgatgctgatactgctggtccagggacttggctttgagaaccattatcctaacacaaaagaatgatgccagtgagaatttctgatggtgtagaaggcttgaggtactccaaatcataggacccctgattgttggaacagc

SEQ ID NO: 41469 - DNA, 416 bp, Homo sapiens
  misc_feature 28: n = A,T,C or G
attactggaagtaagaaatattactatnattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatt

SEQ ID NO: 41470 - DNA, 132 bp, Homo sapiens
gaagggaagagagaaaagattgatactctttaaccctgtaaagtgaaatggaagaaaaacacactgcagttttcaagttcatgaaacagagttacaagaattcagatgcaatttatgacacccgagggaggt

SEQ ID NO: 41471 - DNA, 460 bp, Homo sapiens
  misc_feature 4, 7, 99: n = A,T,C or G
gcgnctnccccaatccagcaaacgttcccaagtaagaactggtggagcagcaagagcaaggagaagaaacacatctggtttggagaaaccatcaatggnggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcagg

SEQ ID NO: 41472 - DNA, 460 bp, Homo sapiens
gaggccttgaggcagccagcgcaggggcttttgctgagggggcaggaggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagatt

SEQ ID NO: 41473 - DNA, 500 bp, Homo sapiens
  misc_feature 2, 8, 53, 55, 160: n = A,T,C or G
cntagctnttatggaccgggcgccaaccccacaggtgtcgtgaaaactacccntnaaagccaaaatgggaaaggaaaagactcatatcaacattgtcgtcattggacacgtagattcgggcaagtccaccactactggccatctgatctataaatgcggnggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtga

SEQ ID NO: 41474 - DNA, 116 bp, Homo sapiens
  misc_feature 6: n = A,T,C or G
aagccnttgtttctactttgatatgactgtttttcggacagtttatttgttgagagtgtgaccaaaagttacatgtttgcacctttctagttgaaaataaagtgtatattttttct

SEQ ID NO: 41475 - DNA, 184 bp, Homo sapiens
gttctttccttttctatatttgttggactagttagaggtgactgcacataccagtgcggaggaaatacttatccaaaccactaaatggctgtcctgcttggtgttgcatttatgggagatactggctgtcccgttagtattctacatttctgagcagtcagcaccatgacaagatattaaacta

SEQ ID NO: 41476 - DNA, 108 bp, Homo sapiens
  misc_feature 2: n = A,T,C or G
anatggactttggaaaatatttttttcctttgcattcatctctcaaacttagtttttatctttgaccaaccgaacatgaccaaaaaccaaaagtgcattcaaccttac

SEQ ID NO: 41477 - DNA, 376 bp, Homo sapiens
  misc_feature 21: n = A,T,C or G
cacagtccactgaaaatattnaattagccaattctaattctgcctacctcgctttgcctgtttctttctgaaaaaactacagtaaaggacctgacccatgccttctcctcactccctctgcctcctgacccattctggtgtgatgaccaaacaatatcagtccttttgtcaatttcttactttctgaggtggcttggaagagaaggaaataaagagagcagaaaaaatgcaatacaaaaataaaacacaataaaagaaagatgagcaggatgattccagtgagcatagaattaaagcaagtagaattaaagttcccttacccttaataacaaaactaaagctatacccattctcttggttaaagagaattatatga

SEQ ID NO: 41478 - DNA, 484 bp, Homo sapiens
  misc_feature 29: n = A,T,C or G
taacgaagctccttccagcacctcctctnttctccttttgcccaaactcacccagtgagtgtgagcatttaagaagcatcctctgccaagaccaaaaggaaagaagaaaaagggccaaaagccaaaatgaaactgatggtactttttcaccattgggctaactttgctgctaggagttcaagccatgcctgcaaatcgcctctcttgctacagaaagatactaaaggatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtat

SEQ ID NO: 41479 - DNA, 324 bp, Homo sapiens
  misc_feature 157, 160, 207, 208, 251, 261, 273, 292, 323: n = A,T,C or G
gaaatcctaacataggtgcaaatggccactcctgtagtttcttttctgtaaaatgggatctggacgaatgataccaaacgtttctttctagcattgtattttataactctggcctatgattgtgttgtgtcttgcattaaaaaaaaaaattgagagnggnagaattacttctgttatctgaaatacctgagatgcactttaaactgnngaaatgtaagctctgagggcagggaccgtatcttatttactgntagtatccgntgcatctagtgnggggcacctggcacacagnaggcactcaataaatatgtattggttaaaanc

SEQ ID NO: 41480 - DNA, 240 bp, Homo sapiens
  misc_feature 33, 161, 220: n = A,T,C or G
gtggttagatgccaagtaatgccactaaacatncttcagtgtagacgacagcacccacaacaaaggattatccagcccaaaatgtcagtggtgccaatgttgagaagccctggactcacctagtctctgccctgtcaaagaggctaataaagaaaaaggcnctcttttggagcctctttagttcatctcctataacaagtgtcttaaaatttgcctttgnggcattgaagagttaaaagt

SEQ ID NO: 41481 - DNA, 398 bp, Homo sapiens
  misc_feature 7, 34: n = A,T,C or G
agcttgngttataaaagaggtttccgtttttcancaactagacttggaaacaaattttttcagtttaacttaagcaaattgtatataagaggaaatgactatggaggagatacgctgcttagtctcatttctatgtaaatagttctgacataaattgtatagagaagtctcctttgtagtttacttttcagtgatgtcatttgtcattaaatcgtcaaggtaggtatgaaccttggagttttaaggtgacaaaaatgaactcattacactttagacttttggccgggttctgtaacttatgcctgtaatcccagcactttgggagactgaggcaggaggattgcttgagcccatgagttcaaggccagcctgggcatcatagtgagaccttgtctcta

SEQ ID NO: 41482 - DNA, 220 bp, Homo sapiens
gaggcattgaggcagccagcgcaggggcttctgctgagggggcaggcggagcttgaggaaaccgcaggtaagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 41483 - DNA, 309 bp, Homo sapiens
  misc_feature 6, 22, 29, 35, 38, 45, 46, 52, 93, 102, 154: n = A,T,C or G
cggcanaaaaaagtatatgtantacgtgncattgntgnaatgcgnntaaccntgagattcttactactgatgagaacattatctgcgtatgcnaaaaaattntaagcaaatgaaagctaccaatttaaagttacggaatctaccattttaaagntaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaag

SEQ ID NO: 41484 - DNA, 106 bp, Homo sapiens
  misc_feature 12, 43: n = A,T,C or G
gacagcactggnaagcagggtacagtagcccaaagtaaaaagnacacatttgggaagaaaagccagggaaaaacgttaaaagaaaatgtacttaccaccctggact

SEQ ID NO: 41485 - DNA, 215 bp, Homo sapiens
gatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacg

SEQ ID NO: 41486 - DNA, 314 bp, Homo sapiens
  misc_feature 7, 34: n = A,T,C or G
cattctngtcttcctaatagcatttaaacagtanacgatttttaaaagttgttttaaacatttagaaacatcatggcatagaaacatttaggactcactctttgtaagtactgacaagcatggtcttgtaatctgtaaagataaggtagaataaatgaactaaaagaaattttagatgactaaaaggactatataatagaaagagggaaatcttggttcttaaaaattcaggcaattgaaacatttctgtataataccaagcattgttgcagtattgtctgaaatggttgcttttctaataaatgaaaatgact

SEQ ID NO: 41487 - DNA, 481 bp, Homo sapiens
  misc_feature 196, 379, 395, 441: n = A,T,C or G
agagtgccagatgattcattgagttccagaaagaaaatactagtactttttttcttaaaaaaagaaattaaactttactagtattcagtttaacgagcggggaatagttgatgtctataatttttaaatacgtggatttaaggagtgtatactcaaaacttttttttactgagagatgtctactaacataaacggntggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagnataattatttttatgntattttaatatattaaggtatagataataacctccccttcttctgngatataatatcaaagttatataaataaagagtactaacag

SEQ ID NO: 41488 - DNA, 469 bp, Homo sapiens
taccctcatttcacctgcgctgtggacactgttaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaag

SEQ ID NO: 41489 - DNA, 101 bp, Homo sapiens
  misc_feature 7: n = A,T,C or G
gttattntctacatttgtattttatccatagcacttattcacatttaggaaaagacataaaaactgaagaacattgatgagaaatctctgtgcaataatgt

SEQ ID NO: 41490 - DNA, 466 bp, Homo sapiens
  misc_feature 29: n = A,T,C or G
ttcctggcaagcccatgtgtgttgagatnttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 41491 - DNA, 211 bp, Homo sapiens
  misc_feature 6: n = A,T,C or G
ctgagnttcaagactagcctggccaacatgttgaaaccccgtctctactaaaaatacaaaggttggccgggcaaggtggcaggcgcctgtagtctcatatgcttcggaggctgaggcaggagaatcgcttgaaccctggacatggaggttgcaagtgagccgagactgtgctacctgccctccagcctgggtgacggagcaagacactgtg

SEQ ID NO: 41492 - DNA, 298 bp, Homo sapiens
  misc_feature 25, 36, 75, 196, 210: n = A,T,C or G
gttgagcatatgaaaaaaaaaacanggataatacantaaaacttatttgaaaaaataaaagttctagaaataagngctacaaaggagaaatttgagagtgtttgacagcgaaccaaataacatgacctcagaagttaggaaaggattctgtaagaaaataacatttgagctgagctttaaaaaaagcctttctgcncctacctgaagatntgactaaaattagagccttagaaccacccccttgtaactgcgtagcgcactggaggagttgagctgtttacctcatttgctctgatgc

SEQ ID NO: 41493 - DNA, 461 bp, Homo sapiens
ccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaattttggttc

SEQ ID NO: 41494 - DNA, 153 bp, Homo sapiens
  misc_feature 55, 61, 109, 112: n = A,T,C or G
atctgaaattactgaacaactcctattcccatttttgctaaactcaatttctggntttggnatatatccattccagcttaatgcctctaattttaatgccaacaaaatnggntgtaatcaaattttaaaataataataatttggccccccctt

SEQ ID NO: 41495 - DNA, 471 bp, Homo sapiens
  misc_feature 212, 392: n = A,T,C or G
gtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggtcaaaagtaacagnttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatgggttttcactctttttatttacttcattttncctttaataacttaatctcttcatggtcaggttttacttcactcttattctttccttggatatgggatgcttatttgga

SEQ ID NO: 41496 - DNA, 290 bp, Homo sapiens
  misc_feature 31: n = A,T,C or G
gaggctcgagggcggtgagcagtgacaattnctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgc

SEQ ID NO: 41497 - DNA, 160 bp, Homo sapiens; identical to SEQ ID NO: 35929

SEQ ID NO: 41498 - DNA, 476 bp, Homo sapiens
  misc_feature 31, 421, 471: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngattaaaataatttgaaggcgatcttttaaaaagagattaaaccgaaggngatta

SEQ ID NO: 41499 - DNA, 351 bp, Homo sapiens
ataacggttatttctaagtatcttttgagtattttttgtcatatatttcgttttttaggcatgattaaaagtgtatttgaggactcttagacacataaagttgaattcctcagattgagagatagttattgctttttaattttgttaagatgctcagctgttggataaataatgcttttgttaaaatcctgtggggcattcatccaacaaatggggtataagaaaggaatgtgtgtttgtgtacatgttcttctatctgttggtcctaaagagtgtaagaaggtaaatttgaccagtgaaattcataattacagagttttatttggtaatccattaataaatcattttcag

SEQ ID NO: 41500 - DNA, 489 bp, Homo sapiens
  misc_feature 1, 30, 31, 344, 390, 473, 483: n = A,T,C or G
nattcaggggcggttggctttgttgggttnncttgtttgtgtccctgtaggtggacgtggttggtgattggcaggatcctggtatccgctaacaggtcaaaatgcatgatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgngaagaccctgaccggcaagaccatcaccctggaagtggagcccagngacaccatcgaaaatgtgaaggccaagatccaggataaagaaggcatccctcccgaccagcagaggctcatctttgcaggcangcagcttggnaaaatg

SEQ ID NO: 41501 - DNA, 428 bp, Homo sapiens
  misc_feature 3, 18, 35, 36, 58, 198, 223, 268, 319: n = A,T,C or G
atnttagaagactgtttnaaaatagacctacacannacaatgccaaacttagcatggnaatacaaaggatatttatgctctggccctaactctgtctttggaatcagatgttatgattcactcatggcttgagctctggtacttacaatgtggccttggccttggtacttaactgttgtaaaattcacattccttatntataaaataagaatcatggctgggnggggtggctcatgcctataatcctagcactgtgggaggcagaggngggtggatcacctgaggtcaaggagtttggaaccagcctggccaacatggnaaaaccccatctctactaaaaatacaaaaattagctgggtatggggggcacatgtccgtaatcccagctacttgggaggctgaggtaggagaattgcttgaatccagga

SEQ ID NO: 41502 - DNA, 464 bp, Homo sapiens
  misc_feature 33: n = A,T,C or G
cgataccataatggcaaatttttgcctattctngtatcttcaaattgtagtctttgcacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatgggtatttttatcggttgggatctttctgtcttctgggttccattttt

SEQ ID NO: 41503 - DNA, 475 bp, Homo sapiens
  misc_feature 34, 383, 422, 472: n = A,T,C or G
gaggcatctgaggcagccagcgcaggggcttctnctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagtttagtttaaaagttgtaggngattaaaataatttgaaggcgatcttttaaaaagagattaaaccgaaggngat

SEQ ID NO: 41504 - DNA, 464 bp, Homo sapiens
  misc_feature 33: n = A,T,C or G
aaagtgctgggattaccggcatgagccacccanccagcctcatttttatgtttttaaaatcagttatactccttacaatccatggcatccgcagttggccaggtggcagttaagatacagttgtcatttgcctgcacatgagtgaacttgatcataactctgtgttgttgtcagttcagctgaattgtgtatgttattgttgttacaagagttgggttcacttgccatttaacatgtcttcaaaaaaacatgttagaataccttgtaatttgacattaaaatgacatacacaagtggcatggaaacagaagtgggccactgcttgtatatgaataaagcagatattcattattgaagacacaattgcaattccttgtttcttgcaaagccataatcaagtcctttattgtgcctacaaaaagaaaatacctaagataaagctgtgctgtatttttgtcactgag

SEQ ID NO: 41505 - DNA, 208 bp, Homo sapiens
  misc_feature 34: n = A,T,C or G
gttaacaccatgtggcaattattttggatctatnacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcattt

SEQ ID NO: 41506 - DNA, 309 bp, Homo sapiens
agtacagaaaaatggtgatggagacaattgagaaaattatgggtaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtc

SEQ ID NO: 41507 - DNA, 226 bp, Homo sapiens
gtcacaacatgttggcactaagttgaagtggtgttgcaggtttgggggttgttattctttgacattttatagttgcaacctagcctttatgtttccatatctaaatcacactttttgggttagcccaaaagtatcttaaaatttgactatggttcaaagtaattctggccactagtaactccaggcacttgcagaagcaaatgcacatcacagtaaaagatcacac

SEQ ID NO: 41508 - DNA, 368 bp, Homo sapiens
  misc_feature 7: n = A,T,C or G
ataatcngtgacatgtaatttaacacaccaatgaaacatattacatctatcagaagccaatagcttttcttcgtgataatatctagtttgggctaggaagagatgaaatgagaagactcatggggttggtgtgcatataaactatagcagtctttttggagaacggtttgggtagtagctatctatcaacatattcgaatggtgcatgtccttcagcccaacctgggttccttgctagtatggaattaaaactatgcagcagttaaaagttggatgtactgacatgaaaagatctccaagacagtgttaagtaaagaaagcatagtgtagagcaacatgtacagtgtttgtgtaaaataaagccttac

SEQ ID NO: 41509 - DNA, 247 bp, Homo sapiens
  misc_feature 30: n = A,T,C or G
tcacccggcagagggggcgtggccaaggtntattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagc

SEQ ID NO: 41510 - DNA, 473 bp, Homo sapiens
  misc_feature 7: n = A,T,C or G
atgttanacttgatttggttgtaaactatattttaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgacgcctaagcaggtaagcagatgcctaagct

SEQ ID NO: 41511 - DNA, 232 bp, Homo sapiens
agggcttttattttttcttttgtaattgtgtaaaaaatggaaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaat

SEQ ID NO: 41512 - DNA, 466 bp, Homo sapiens
  misc_feature 20, 34: n = A,T,C or G
attgttcaatgccccaaagnatcttaaacaactngagaacaatagcttatcatgtacagggaatattgaaatgattaatggctgacttcttatttgaaacatgaaagactaaaagacagtggaacacatattccaacatgttgaaagataagaaaaaatgtcaacaagtttttgatatcaagcaaaactaacctttaaaaataaagacaaaacaaataattcccagaaaaacaaagacagagaatttgttgccagcagacctgttttacaataaatactaaggaagtgtttcaggctgaaatgaatcataccaggagctaacttgaatccacggggagaaatgaagagtactagaaatagtaaacatatgggttaatataaaaggcttaaacaacctttttcttattcttctcttaacatcttaaaagacaaaattatgtaaatccacaattataaaactatattg

SEQ ID NO: 41513 - DNA, 297 bp, Homo sapiens
  misc_feature 34: n = A,T,C or G
agaagccgagtatttaaaagacccaactcatttnatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatg

SEQ ID NO: 41514 - DNA, 150 bp, Homo sapiens
  misc_feature 32, 54, 87, 124, 137: n = A,T,C or G
atatttcattctcttatatagtattcattttnctacctatattacacaaaaagnatagaaaagatttaagtaattttgccctcctangcttaaatgccatattcctgggattatttacaatgcngaattttttgagnaattctagctttc

SEQ ID NO: 41515 - DNA, 499 bp, Homo sapiens
  misc_feature 5, 30: n = A,T,C or G
actcnaaattccttgaagcttgtttctttnaggtagcaggagaaagaaactctgacttctgacttctaggccattttttggagagctaatcacttgcttagaccagaccaaccctgaataacctttgattaacttaaagtcaactgattaaggatgctaattacatttgaacaatcctttaactttgccatattccactgggtaaaagaaaattacagatgttgaccatctgggaggagatagtgtaagggcctgagctattggagatcatcttagaattctgcccaccacaatcgtgttctatgtttatgcaggtatatgtgtgagcgtgtatttatgtgtgtagttaataacttaaaaatgaattacatgtatcccaaaacaagcggcaactgcacatcccatgccttcttacttggattagtttttcctgaagttactccagggtcctgtcttcccattgttaggtttcctttctgctgtcctggcttcacctttc

SEQ ID NO: 41516 - DNA, 386 bp, Homo sapiens
  misc_feature 55: n = A,T,C or G
caaagggcaaactgggttgcatcatatgaccaatattttgttttataaatagggntcttcaaaatcaatagtaagaacataaatattgtccagttcaaaagacagacattttacccaggaaacaaacataaatattcctgcttcactagtgttaaaatgcagtagccagatgtgatcattttaaatgtatgtgtatcaaacaacacagccacaaaatacattaaataaaaatttccagacttgaaaggagaaatagataagtcaacaattacagttggagatttcaacacttctcattcagtaattgatagaacgattgcagacactcaaggatacagaagacttaatagtcaacacatttgatttaatcattattagggcacact

SEQ ID NO: 41517 - DNA, 372 bp, Homo sapiens
  misc_feature 7: n = A,T,C or G
gacaacnccatgaacagttttatttatttgcgtatttatctatttgcaaattattcttctcacatttgactgctatcttccccttgtggaaatttttatcttggaagtttggggagcatcagtggagtacatgtggatgctcccaactcacatctgatgaggaagctgccttcgtacacgcaggcaaagtgcattcgacagaatatgaaaaaattaagccagcggacaattaatatagtgagaagtgctttacatccggaacatggactgcctctcaccaagcattgggtacttcattcttctctgaagctggccaaaagacgtgaaagcaacctcactaatttacacgatccaccgaaagaagaaatctgt

SEQ ID NO: 41518 - DNA, 460 bp, Homo sapiens
  misc_feature 364, 423, 424: n = A,T,C or G
cagcctctcaagtagattcagccgcattttacaggtgaggaaactgagtcacagagcggtaattcacttgcctggggtcacacagctaatgagtggaggatctggagtttaaacacagaaactctggctgcagacccctgttctcttgacttatctgcatctaaggaaaagagagaatgtggccgggtgcaagtggcctctgcctctcaaaatgctgggattacaggcgtgagccaccacgcctggctccctagattgatttcatgtcttggctatattgtgaataatgctgcaatgaatatggggagtgccaatatctctttgacatactgattgcatttcctttggatatatacacagcagngggattggattatactatagttatatttttaatttttttgaggaaacgttatactgttnnccataataactatactaatttatgtccccacaaaca

SEQ ID NO: 41519 - DNA, 478 bp, Homo sapiens
  misc_feature 2, 7, 9, 10, 15, 46, 48, 59, 91, 92: n = A,T,C or G
cngccgngnnttcgncttcggtttttcttttaccttcgctaacgcntnccggctctcgncagcctcaccgtcgtccgtctccttaacaccnnacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaagggtttgcttgatgttacatgcaagactgttgccaatatgatc

SEQ ID NO: 41520 - DNA, 408 bp, Homo sapiens
  misc_feature 371: n = A,T,C or G
gtttctgtagcacatgggacacccagcagtgcacatcccaatgagttccaaaggccccatccctatgggtagcttcccagcaagttctgtaccaggtcagctccccatggggagcttctagcaccccagagtgtggctcctcagtgagttctgccagctcagcactgcagtggcatctccatccagtgggctgtggctgtgccctctccaacaaggcctggatctaagacctggcaggaaaggggaaagttgtggcaccctcctgcaaatttgttcttacctttgatgttctgcctcagccctagagacactctatatctgttattgctgtattcttttgagtttcactttttgttataacacttagtagntaataattcttaacattaaactttccctgttcaaatg

SEQ ID NO: 41521 - DNA, 236 bp, Homo sapiens
  misc_feature 32, 211: n = A,T,C or G
atctccaggtgagaggatcgcttgaggacatnagtttgagaccagcctgggcggcagagtgagattctgtctcaaaaaaaaacaaaaacaaaaaaaacacgtactccaggccaggcgcagtggctcacacctgtaatcccagcactttgggaggccaaggtgggtggatcacttgaggtcaggagttcaagaccaccctggccaacatggngaaaccccatctctactaaaaaaaa

SEQ ID NO: 41522 - DNA, 306 bp, Homo sapiens
ataggccatatttgataataacattctttttaatgtactgttggattctgttaagtgatatttaggattttgcaagtgaagtgagcctatacttttcttgtttggttcatctctaagtttgggatttatttttattatctttataaaagtagctggtcagttttcatgcttttttcttttttgtggaacagcttatatagaattggtgataggatcacaacttctgaggtcccagcaagagtcctaacatctagcagctctaccaccaggacaggccccctaaaactaattccaacaagcacctcc

SEQ ID NO: 41523 - DNA, 354 bp, Homo sapiens
  misc_feature 10, 18, 27, 28, 34, 39, 41, 48, 49, 60: n = A,T,C or G
cttttttttnggggggcnctttctccnncccctnggggnantcccccnntttggggcctncttctctcaactcttcaaagtcattctccgtccagctttgttccattactggtgaggaactgcgaagttggggtatttgcataaatgactctgactcgatgagtagaccttttagcagacttcctttatcttattagaactcctggtactgaattttcctagctgttctatctggatgccacctgaattcaggtgtggcatggagtttatttgttaagggcactgcagagtaattcttttattgaatagaaagttaggctacatcttccaaatgtaagcatgtttattttcttg

SEQ ID NO: 41524 - DNA, 335 bp, Homo sapiens
ctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttgt

SEQ ID NO: 41525 - DNA, 121 bp, Homo sapiens
gtttcttgattgtctcttagttttaagtcttgttggaaaaaatttccttacatccaggttatagagcaagacatgtgtaaatacaatacatgtgtaaatatttagtagatacatttacaac

SEQ ID NO: 41526 - DNA, 470 bp, Homo sapiens
atgacaagtgctgtcccgattatgagagtttctgtgcagaagtgcataatcccacatcaccaccatcttcaaagaaagcacctccaccttcaggagcatctcaaaccatcaaatcaataaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatct

SEQ ID NO: 41527 - DNA, 136 bp, Homo sapiens
aagaagggaaatgataaaacttattgcataaattagtgaggttgaaggcggaaaatcaataaacaaagtcaatgaaactggaatctatttctttgaaaacattaataaaattgatgagccccttgccaggctaagc

SEQ ID NO: 41528 - DNA, 468 bp, Homo sapiens
agaaatagtattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatc

SEQ ID NO: 41529 - DNA, 172 bp, Homo sapiens
cagaaaatagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagca

SEQ ID NO: 41530 - DNA, 302 bp, Homo sapiens
  misc_feature 252, 254, 265: n = A,T,C or G
attgtaaccctgtttttaagctgttgcatttgtctaaaaatggaatgtaataggtaaaactaacttactaattttgttaacagagtgggaggctaagcaaagaactggatttagtaagtcaccatgtgaggattgcttgagcccaggaggtcaaggatgcagtgatccatgattgcaccattgctctccagcttgggtgacagagcaggaccatgtctcaaaaaaaaaaatgagagagaatttttaaaaatntncatgttaaatngcattccactctaggttcaaggacactacctttaact

SEQ ID NO: 41531 - DNA, 378 bp, Homo sapiens
cattgtgtttggtgttttacaagaacttttaccatactggcgtgtagtccattctgtacagtttaaaagtgattcacgatttgcaggctttttatcagatcacaaaaaaatcagtctttaagcatttgcttggtaaggtttcttaagattaggtttataatacaaccatctgtaatgtatctctcgtttgagcttgtgggccatacaattcattaactagatgaatacattgtggacagcatcctcactacccctctctactcactcacaaagaaccatgatacactggaatgtttttctctggaatcctctttctactcttgtattaaaatttttccccacttcatgattatattcaaaataaacaactacatcatt

SEQ ID NO: 41532 - DNA, 298 bp, Homo sapiens
acgttttttttaatctgtgccaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacac

SEQ ID NO: 41533 - DNA, 428 bp, Homo sapiens
caatgggaaataaatctgtgaaatgtttgaaatggaattcaaattagtaacattaagaatagtgaaatataagagaacatagaaaaatataaaagaaatgagaaaagtcattcatgatttgagtaagaaattcactagcaaaatggatattctaaaaaagaaccaaacagaaatcctggaaatgaaaaattcaatgagtgaaaaaatacaatcaagggcttcaatcacagactaaataagcagaagaaaaaatttttgaactttaaacaagtgttttgaaataaccttgtcagataaaaccaaccaatcaacaaacaaaaagctaaaaaagaaagagtagaacctgtgtgacatatgagacaacataaggtgaccaaatattgaaatttggggtatcagagaaggaaaagagattggcaaaggaacag

SEQ ID NO: 41534 - DNA, 473 bp, Homo sapiens
aacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcaataaaattattagccttaagattggtaagctagcaatgaatgctagggtgggaagctggtgagccagtggccattagataaatacctttcaagtgtgagcttagacgtcaaccctaaaatacttaaccgtaatgcta

SEQ ID NO: 41535 - DNA, 472 bp, Homo sapiens
agaaaaatgttacagagatactatttttttggttggaattactatcttaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtg

SEQ ID NO: 41536 - DNA, 471 bp, Homo sapiens
aaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaaggtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcaacgggagtttgacaggcgattctcccctcattttctggactg

SEQ ID NO: 41537 - DNA, 469 bp, Homo sapiens
catgattatctaccgggacctcatcagcccgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtga

SEQ ID NO: 41538 - DNA, 233 bp, Homo sapiens
  misc_feature 233: n = A,T,C or G
tatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctn

SEQ ID NO: 41539 - DNA, 295 bp, Homo sapiens
gttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttattc

SEQ ID NO: 41540 - DNA, 260 bp, Homo sapiens
aggggaaattccctactgaagataactttgtttgaatgagtgcgattacaatggaaatgctgaagctttcgtgttgattgtgccgtcaccacagtgctggtgctgcgtccagagaacgtggtcactttcttgactatctatgctgcctcaactctgggccgcaggtccctcatttgtaaaatacatttttattgtatgattgctgaggtcccttctaggcccaaaattctatgatttcacataggcctttcagttatgtc

SEQ ID NO: 41541 - DNA, 213 bp, Homo sapiens
attgaaagagcagcatacgtgacttatcttcccctttaattgttaattttcagaataatgacttgataccgtagcaaccctcaataatgtctaattaattttggtttttacccttatttttttggtatcattataaactcattgctttttatcaatttaatgcttaatcgattgcactccatcctgagggacagaacaagactctatctcaac

SEQ ID NO: 41542 - DNA, 473 bp, Homo sapiens
  misc_feature 452: n = A,T,C or G
cttagaaataaagacattctcctacataaccacaatataactatcagaatcaggaaagtggcattgtacattatcaccatttaatccccaagaaactattcaggtttcaccagttgtcccagtaatgctctaggtggcaaaaagattgagttcacaataataccttacatttatatgtcttaaatcttctttaatctagaacagttaatcatcttttttgattttcacattatatttttgaagataacaggatacatgtttcttagtttttttacaggacacttttgaaaattttgtagattgtcctctcaatttgggtttgtctgtacagtttcatcattaatttcaggttatacatctttgccagatatatcaccaaagtgatgctatgtttttctgattgtttcttggtgaatggcatgcgatttttatttttattggtctttattggngatgctaactttgaccccttg

SEQ ID NO: 41543 - DNA, 466 bp, Homo sapiens
gaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctcctt

SEQ ID NO: 41544 - DNA, 103 bp, Homo sapiens
aatgacatttatcttcaaacaccaaattgtctttagaaaaattaatgtgattacaggtagaggccttctaggtgagacacttttaaggtacactgcattttgc

SEQ ID NO: 41545 - DNA, 401 bp, Homo sapiens
aaaagttgggattattttaggaagaagaacaatgaagagaatagatgttggatgggcagccatcaatattccaggatgttttatcctttcagatttttcattaaggctaaaatgactcagtccaggaggagaatcctcacctcatcttcttccataggcttaggtgtggagaggagatagaaggaagtttttttaaaaagtaattagaggtatagaattgtaggcttcttatactcttgagtctctgtcattgtgtcaaggaaaccatgaaacgcgtgacaaatgtgtcatatcttatgggaagttaattttacttgaagtggttgaggtaggtggtaccttgtttttatgaaaaacgcaggtccatttcaaaatagaaatataaaacataaattgtttag

SEQ ID NO: 41546 - DNA, 117 bp, Homo sapiens
tccgccttcttttctacgtgaaatcagtgaggtgagacttcccagaccccggaggcgtggaggagaggagactgtttgatgtggtacaggggcagtcagtggagggcgagtggtttc

SEQ ID NO: 41547 - DNA, 471 bp, Homo sapiens
  misc_feature 466: n = A,T,C or G
gaagcaaggaagaagctcctgggcgctggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagagtacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggangtttt

SEQ ID NO: 41548 - DNA, 465 bp, Homo sapiens
ctgaggttcttcactcgcgactgacggagctgcggtggcgtctccacacgcaaccatgaagttgaaggacacaaaatcaaggccaaagcagtcaagctgtggcaaatttcagacaaagggaatcaaggttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatcc

SEQ ID NO: 41549 - DNA, 375 bp, Homo sapiens
gtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttg

SEQ ID NO: 41550 - DNA, 201 bp, Homo sapiens
attgggaataatttcattacctgctactaggttggtgcaaaagtaattgcagtttatttttgacccttttgaaaattttgaacattttgaattcttggagtatgcaatgaatatcttttgggaaatttcccatggataaagagaaaatcttttttggattcagtgattttagaacatatacatacttcctgctgacaggcc

SEQ ID NO: 41551 - DNA, 253 bp, Homo sapiens
gcatccaaacttaacatagatattattattagcagaggaggatagtaaaacattagttataactgtatttcgtattgctaagaaggtaagtacagcaatagaaagtattaaaaaaaattgagattctagggagaaaacctatattgcctgaaatgaaaatataccaggttaacagaagattagatttccagaagaaaagttgggtgaacttgaaggcatagcagtaaaactatccaaaatgaaatgcagagag

SEQ ID NO: 41552 - DNA, 198 bp, Homo sapiens
  misc_feature 19, 191: n = A,T,C or G
aattaaccccattctttcngcgccccgcaccatagcacctgcccacctgagaaccaggaacgcaccctctctgtggagctctgactggtgtagctggaaacaaacagcaacttgcaaacggacgaaagagcctgccgtgtgttaatcatttgccttacaagatgtaccagacgggtttccagttccttaanaaaaggg

SEQ ID NO: 41553 - DNA, 469 bp, Homo sapiens
ggcaaagcaggcttatgaacttgagcagccctgtggtcaggcacagcaaatgacaccagcaaggtcagttgtacaatataaataagatttatagaaaaagctccatacctttaaggttgaaccagggagttgtggaagtgagaagaggtttttggtttgggtttttgtttttacattagagactctgttctgacaagtgcaaggctcttgcaagatacctgtggcaatcaaatccagtgcttgtggtgggggtttggagaacatgggtctccttagctcaaatcatcctcctcagtggggagtaggatggtgactctctttggccaaaccatgaaccctaaactttatggagctggactaaccaacttataggacttgaagaaagaaatgagagctccaacttcattcccagggtctcccaagtcagaaacctcaaatgcctctctcttgtttttctgctcttgataca

SEQ ID NO: 41554 - DNA, 242 bp, Homo sapiens
  misc_feature 13: n = A,T,C or G
gaggtaagaaacngtgtcttcaagagccgggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatac

SEQ ID NO: 41555 - DNA, 171 bp, Homo sapiens
gagtaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtg

SEQ ID NO: 41556 - DNA, 472 bp, Homo sapiens
  misc_feature 168, 190, 217, 297, 458: n = A,T,C or G
acttgagcctggggctgtagtgagctgtaatcgcgccactgcactccagtctgggtgacagagtgagatcctatctaaaatatatatatatatatagagagagagagagtaataaatatatatatgtatatacataatgcttataacagatgaagtcttaacatatanaattgtctgattcttttatgtntcattctgttatgtagcatcacacgtngattctgtttacttttcagcatttttcaagttgttattttaaaatgttatgttaaatgtggttaccaattgcattacagnacactaatgcactttaataacattttaaaatgttatttttaaataacacctttaatggaatcactgcattgtttaaacaatcaaaatgggcagggtgtgatggctcacacctgtaatctcagcactttgggaggcccggcaggcggatcacttgaggtcangagtttgagaccag

SEQ ID NO: 41557 - DNA, 384 bp, Homo sapiens
agtgacaggtgccatccgtctctctcttctactgtggtagaagtggaaacgtgtctgtttctggctttaccatggagtgcttagagcagtgatcagcacatagtggtgctcggtaaatatttgttgaatgaatgactacataaaataaagttgagattggagagccaaattttattaaaattcgggaagatcgatttaagctatatctggtgtcactttaacacactatacataatatcgtgataatatatattcacatgatattcacatatgtatcatacatatgtatgtatatgtatatattgcatatatacatatgtacaatcttcctactcgctatatgaattaaataattttggtaagatgactatctcttctagtaca

SEQ ID NO: 41558 - DNA, 463 bp, Homo sapiens
aggtggtgatgagcagctcagtctttagaaaataggagaatctaacttggtaaaaagagactatggtaggctgatgaactcataacatttgcatcagattatttataaatataagcaagcataatattaaaagttttagtattactaggaaagtacaaataggtttagtttatttaaaaagcctttattaatgagaaaatctcatcatagaagcaggtggaccttctttgtttttctgaaaaacaaggaaattggtttaagaatgagttcatgttgctttgagggcctgacacatgcctgaatgtgacctactacaaccacaaaaaacaatttaaaatgaagccctaactattttataatggaatgcctaatttgtgctgggaataagcacaacaaacctgactataaaggaaagggaagttattctttatatttgggaatgcctttaaatttctttttaatt

SEQ ID NO: 41559 - DNA, 472 bp, Homo sapiens
  misc_feature 22, 26: n = A,T,C or G
agggattgagagtattaaagtnagtnaattaattggaattatatatcaacatatgcccagtaaatacaaatgaagattgattcttactcaggcatattgtatcttaatgaaatttagttgaagttgcaaatagaaaagccaacattttccatttgtttatttttcattgaaacagcttgactggctttgttcatgatatagcaaaagtagctcttaatgctggttagcagaaacattgattgccaggcagctgtctaggaaaacttaaacccatttcacctaacaagccagaaatatttataatacatgttatttgggtagttaaatcccattctctggaaatttcttaaggctggttctttatgtccacatgccttcatgttacttgaactttgtttatgccttttcaaaaaatttcagcattgaagctttgctcagctgactcagttggactaatatttagcaaagattc

SEQ ID NO: 41560 - DNA, 221 bp, Homo sapiens
agaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 41561 - DNA, 421 bp, Homo sapiens
gctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 41562 - DNA, 472 bp, Homo sapiens
cagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatac

SEQ ID NO: 41563 - DNA, 399 bp, Homo sapiens
  misc_feature 356: n = A,T,C or G
actcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggtaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttnggtgttggctggggtgtcaataaagctgtgcttggggtcgcgc

SEQ ID NO: 41564 - DNA, 110 bp, Homo sapiens
gtagccagtctataatataattatgatcatgaatagactccagaatccacaaagagaagagggcttggatgtcaaaaattcttccattgtggggtaggtggtcggggatg

SEQ ID NO: 41565 - DNA, 348 bp, Homo sapiens
  misc_feature 157: n = A,T,C or G
cagcagggtttctggggaacgtagatttgcgtgacaggggccctgtgttgctaaggaattactgcaggcactgagaaaagtctcagcgtcagacactcctccacctcccgggtcctgcttccctccctctcccctttccaggcaactcacagtttangggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaaaaataaaagaataaagaataaaaagaataccactacta

SEQ ID NO: 41566 - DNA, 200 bp, Homo sapiens
  misc_feature 10, 14, 33, 48, 49, 139, 172, 177, 192: n = A,T,C or G
cacccagggnattncggccttatggcccggggnacattggggccgggnngttgggagcggctgaactgcgcagcaaagacttttattctcgtctccttcagtgtcctgcagagataagtgatgactgactcctgagtgngaataccgggagaataatggaggtctgtttttncatgngggtctgcgtttcanggaatttt

SEQ ID NO: 41567 - DNA, 231 bp, Homo sapiens
  misc_feature 108, 231: n = A,T,C or G
agatggagaaaatccaccgctcttcaggagaagcacgccatgaaacaggccgtcgtggaaatgatgagtcagaagattcagcagctcacagccctgggggcagctcangctactgctaaggcctgggagtttttgcagaaatggggcagagggacaccctttgggcgtggcttcctggtgatgggaagggtcttgtgttttaatgccaataaatgtgccagctgggcagtn

SEQ ID NO: 41568 - DNA, 187 bp, Homo sapiens
agaggggccgtggcccctgcagcggaaccggacccagtccctgagccgcccctacacccacagacagcatcgcacagaattattttaaaaaaagcagtgatccaagcaattgaattggaagcactctggggaaacctgctgtttattgtggaaatcatcttcgatcttggaattgaaagtaaagctg

SEQ ID NO: 41569 - DNA, 370 bp, Homo sapiens
attgtgagttaatggtactctatatcccaagtacgtgttaaaattagaagcataccttctatttgaaatataacaacatggaacatcctttaccaccaaaagcatggcaaagctccaggcaataaatgaaaaatggagagagcataggtacagaaaacacacacacaaagtctttggatcagaaaaaaactgagtttgttactacctttaaaaagcttctatatgaacaatttttttctctatgattacaaaggaagtgtttgtcccgtgacttttttgaactgcatcagtgttgccttttgctctgacttgctatgacaagggtaaagttgcttatgcaacaacttaattttaagattctgttttctca

SEQ ID NO: 41570 - DNA, 403 bp, Homo sapiens
attgtagaagatgttgatggcatactggtagtgatataacactgaaagaaagggggtgggaaaataattgcagaggacatttttgaattaatatgtaattaatcgaatgatacatagtgtgaacaaatcttaatccaataatttaatggtagttatatctagaatccttaaatcccctgaccaataatctatcattacctccagtgcccccttgaggcaccctgagagtggatgctcctagctaatgaatactcttgatgtctcagaaacagactagaccacaccactctcaagccaaggattccctgtttgtagttactaatccatgacacaaactgaaggcaagccaaattcttaaatctatcctacttccctatggggaagatatacagtattcaatctc

SEQ ID NO: 41571 - DNA, 119 bp, Homo sapiens
gatgaatactgcagaaaacaataggagtttaaaacagggagttaggcagtttttcttaagtaaatgatacctaagataatatttgaaattatttaagtgatatctggggagtggggagc

SEQ ID NO: 41572 - DNA, 115 bp, Homo sapiens
tggtgcatgcctgtaatcctagctactaggctactaggctgaggtgggaggatcgcttgagcccaggagtttaagtccagcctagttaacatagcaagacctcagtctcttggag

SEQ ID NO: 41573 - DNA, 471 bp, Homo sapiens
gagagactgcgcgatgtcctctcctccatgaagctactatgcaaactatggagagtctcctgagggccaaaggcctggaagtggaacagttatctactacctgtcaaaacctccagtagctgaaagaagaaatggaaaccaaatttagccgttggcagaaggaacaagagagtatcattcagcagttacagacgtctcttcatgataggaacaaagaagtggaggatcttagtgcaacattgctctgcaaacttggaccagggcagagtgagatagcagaggagctgtgccagcgtctacagtgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattac

SEQ ID NO: 41574 - DNA, 366 bp, Homo sapiens
  misc_feature 346, 350, 366: n = A,T,C or G
taagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattggttcttgaagtaccttttggttttagcataatggtgggcatttatctaanggtnggagaaacctttgggn

SEQ ID NO: 41575 - DNA, 184 bp, Homo sapiens
aagctgggggaagttaaatatgagccctgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgc

SEQ ID NO: 41576 - DNA, 470 bp, Homo sapiens
catcagcccacacctggctctggcctaagctctgggatacaaggcgatggatgaggtataccatgccccctagtaatgagctaagtgttagttgctatgttgcagagcagggtcacattaactaatattttaagcagtaacgatacagtgctttgggcgttgacataaggaagagatggactgggagttgttttttgtttttaagagggaagaattgaaaaaagttagtggatagtagactttcaaaaatgtttgtccattagaatggagttgtatgtatccagagggtaatattcccataggcataaaatgttaagaagactgactcatacctggaatttggaaaggtagccttcccagatattttgggaacttctttgttgagagagagagagagagatgcccaatatgacagcacattgggcatcaggcatatggctgatcctggggccgcaggggaccatgaaaag

SEQ ID NO: 41577 - DNA, 262 bp, Homo sapiens
catgggtgagacctgaccgtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaaggaaggttt

SEQ ID NO: 41578 - DNA, 471 bp, Homo sapiens
attcattcgagtgcccgatccctggatgagatgaaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacatttacgtgcagcacaatagtaccgatcagttaactcagcgctgaagggcttgtt

SEQ ID NO: 41579 - DNA, 336 bp, Homo sapiens
attgatattctagtgaaaacaatactgcactttaaagaaaaagaaaaaaggatctagcccaggtgcagtgactcacatctgtaatcccagcactttgggaatccaaggtgggtggatcgcttgatcccaggagttcgagaccagcccaggcaacatagtgagaccccgtatccatttttaaaaaaaattatccaggcatgatgtcacacacctgtagttccagctacttgggaggctgaggtggtaggacaaactgagcccaggagtctgaggttgcagtgagctgtgatcacatgactataatccagcctgggcaacacagtgagaccttgtcga

SEQ ID NO: 41580 - DNA, 143 bp, Homo sapiens
  misc_feature 28, 89, 120, 122: n = A,T,C or G
gaattacatccggtgaaattctattggngtattcccgaggagtaaccagatttctggtcgcagtgaaagtatttttagatacagtttgnaataaaagctcttatcaactttcttaaaagnantacatagattttcattgtact

SEQ ID NO: 41581 - DNA, 125 bp, Homo sapiens
  misc_feature 125: n = A,T,C or G
aatgaagtgtggttgattcaaaaaaatgaacccaccaaagaaaacgaatgagaaaaatgaaaggaagttctgctgtcagaggcaaaacatctgtttatcatagacatcaacatgacctataagtn

SEQ ID NO: 41582 - DNA, 465 bp, Homo sapiens
agacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggtgaattatggggaag

SEQ ID NO: 41583 - DNA, 473 bp, Homo sapiens
  misc_feature 464: n = A,T,C or G
aagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaaatttgtcacggatttaagttgtacaactgtttaaaaaaagtttcaanaaataaaca

SEQ ID NO: 41584 - DNA, 105 bp, Homo sapiens
agaacacatgtatctaagtttaactgaagtaaacagttacagactttagtgtttacctatgtcatcttttagcatgaagtgattcactcctgagttgacacatac

SEQ ID NO: 41585 - DNA, 468 bp, Homo sapiens
cgtcttgttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgtg

SEQ ID NO: 41586 - DNA, 471 bp, Homo sapiens
aatggaacctgcagtatctccaaagtatgcttgtatttaaatcttgcttaagaagctaaagaaagagtagcaaattcttcctgaaataggtagaagaaaacataaaaattttagcatatgtcaataaataaagagcagataaagtcaaaagttggttctttaaagagattaataccttagcaagtttgataaaaaggggaaaacacaaattactaccattaggtataaaaacggaatatcagaatagatcctccacattttcaaatgatgatactggaacattattaaaaacttcacgtcaataaaacccagtatctcaagtgaaatgtacaaatttctttaaaaatataaatttcaaaatttacaatgtaagaaaactgaacatctaaacggccctataactattaaagatattaaatatgtaaatttaaaaaccttttcacaaaggtaacttgaagcccagtttgcttc

SEQ ID NO: 41587 - DNA, 185 bp, Homo sapiens
aacatattaaccttaaatgtaaatgggctaaatgccccaattaaaagacacagactggcaaattggatagactcaagacccataggtatgctgtattcaggagacccatctcacacgcagagacacacataggctcaaaataaagggatggaagaatattaccaagcaacggaaagcaaaaaaac

SEQ ID NO: 41588 - DNA, 420 bp, Homo sapiens
  misc_feature 31, 33: n = A,T,C or G
acctgctgtgcctcctcctgtggtggaggananggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttatttttagcagtgcaaaagagttcctttatcctccccaaggatggaaaatacaatttattttgctta

SEQ ID NO: 41589 - DNA, 486 bp, Homo sapiens
  misc_feature 212: n = A,T,C or G
aggggggattgagagtgctctaaggagacttttcctccggtgggaagagataaaaagaccttaattagttgtttatcaagtgacatttagttgtttggttttgggttttctttttttgattgcgatttttcctctgattaaaaaaaataataataaaataaaaaaaggttaactataaggagatggcctttcctccttttttttcttaaggngctgttttgggggaaaaaaatgtaatgaaatgaccaaaagaattacacagcattaattaaaaatggaagttttccacttccttgataatttggctatctgaataaatttgtgaatttgctaggttaagacctagttcgtggacacatttcaacaaaacagcttgagtataaagaaaataataaaaggctgttcttatttattttcctttgggggcttttggggttgctctttttgcataggtcatgactttgttctcctgggtccagatttata

SEQ ID NO: 41590 - DNA, 472 bp, Homo sapiens
gtttcagggaaaaatgtctttaatgctttttcagaactaacacagttattcctatactggattttaggtctctgaagaactgctggtgtttaggaataagaatgtgcctgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaattttagttgtacatttaactttgtataatacagaaatctaaatatattttaatggaattcaagcaatatatcacttgaccaagaaattggaatttcaaaatgttcgtgcgggtatatacca

SEQ ID NO: 41591 - DNA, 470 bp, Homo sapiens
  misc_feature 189: n = A,T,C or G
aacaagtctgcaaaattaactgtccgattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggnggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatac

SEQ ID NO: 41592 - DNA, 276 bp, Homo sapiens
  misc_feature 15: n = A,T,C or G
cgtgatgggcagatnacttgagtcccaggagttccaggccagcctgggcaacctggtgaaactccatctctacccaaagaagtatatgtatatgtatagtagccaaatgtagccaggcatggtggtacatgagcatgggcctgtggtcccagctacttgggaggctgaggtgggagaatcacttgaacccaggaggtcaaggctgcagtgagctgtgattgtgccaccgcactccagcctgggcaatgagtgagaccctgtctcaaaaataaaaga

SEQ ID NO: 41593 - DNA, 103 bp, Homo sapiens
  misc_feature 10, 21: n = A,T,C or G
acttcatatnaaacttgaganaaggttaaaactgtgcccagaggaaaactggtagtctacttttaaaagcactttaggttttgacacttaaatatgaaagagt

SEQ ID NO: 41594 - DNA, 415 bp, Homo sapiens
  misc_feature 26, 295: n = A,T,C or G
gaaactgtgcagaatgaaaaatattnactttcctttaaaatttgtttttgtttaaatttactaaactttaaccaagaaatctttacagccaagaatatgtttttagcatcttgatttattcagaagtctagtgatagagaaaagtgcacccaaaatatgaatgattccctctctttttcatccccatttttcactttttacatacccatcataattatttcgtattattttcttccttttactgtccttttatacaaggtcataagccataaaatatgaatatttattgggtgtnttctaagacagacatcttactatgccttttcatgcattatctcttttatgtcttcagaaaaatttgataggcaaagtagtaatgtaataatagaatgacaattttttagagagggaaatg

SEQ ID NO: 41595 - DNA, 226 bp, Homo sapiens
agaagttgttgagctcaaatgtatcctacatccagctgtagaaatttgtcagaaattgtttaaattttgtatataattgtactgtttaattctagccattgcgctgaacagtatttgagttaccatataatatggctttacacaaggaaatgtgtggcttttgttttgtattttttcagtatagaagttcctgtgtcttatttaaataaagttattagtaaaaccg

SEQ ID NO: 41596 - DNA, 282 bp, Homo sapiens
  misc_feature 9, 31, 44, 276: n = A,T,C or G
gtctgagcntgaagtataaatactgaaagangtcacttttattnggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgttttttttttngggggg

SEQ ID NO: 41597 - DNA, 427 bp, Homo sapiens
  misc_feature 33, 43, 47, 52, 60, 265: n = A,T,C or G
cgggacctcggcccctacggccggggagggaancgctgagtantggntgaanggaaaggntgagagaaaaggatgagagaaacgatgagggaaaggatgagagaaacgatgagagaaaggatgagggaaaggatgagagaaaggatgagggaaacgatgagggaaaggatgagggaaacgatgagagaaaggatgagggaaaggatgagagaaaggatgagagaaaggatgagagaaacgatgagggaaaggatgagagaaaacntgagggaaaggatgagagaaaggatgagagaaaggatgagggaaaggatgagagaaaggatgagggaaaggatgagggaaaggatgagggaaaggatgagggaaaggatgagggaaaggatgagagaaacgatgagggaaaggatgagggaaaggatgaggg

SEQ ID NO: 41598 - DNA, 367 bp, Homo sapiens
  misc_feature 311: n = A,T,C or G
gtggctgtaccattttgtatactttattttttaaccttgaactttacagataactctggctttcttcctcttcccctctacatgttcagagttaggaaacaaagtgaaataaattattggatattgatttggcttttttaaagtgctgggattacaggtgtgagccaccacgcccgaccccattctttttttagtgtgtatttcagacagtctttttgttatcctgtcagtgtacagaccaacagatactttgaaaaatacctttttaggactattataaagtaattattacctagcatttacataactgncactctaaatgacccccaaatactttccagatttatactctaatacagagctgcct

SEQ ID NO: 41599 - DNA, 295 bp, Homo sapiens
  misc_feature 91: n = A,T,C or G
gatagaagtttgaagtggaaaactggaagacagaagtacgggaaggcgaagaaaagaatagagaagatagggaaattagaagataaaaacntacttttagaagaaaaaagataaatttaaacctgaaaagtaggaagcagaagaaaaaggacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtat

SEQ ID NO: 41600 - DNA, 376 bp, Homo sapiens
  misc_feature 326: n = A,T,C or G
gaaatgagatgaaaagatgaaatgatgagatgaaatgaaatgatgagatgaaatgaggtgaaatgaaattagatgaaatgtaatgagatgaaatgaaatgacctaatgaaatgaaataatgaaatgagatgaaataaaataatgaaatgatgaaataatgaaatgaaaatgaaatggaaatgatgagatgagaagaaatgatgagatgaaatgatgaaatgatgaaatgagatgaaaagatgaaatgatgagatgaaatgaaatgatgagatgaaatgaggtgaaatgaaattagatgaaatgtaatgagatgaaatgaaatgacntaatgaaatgaaataatgaaatgagatgaaataaaataatgaaatgatga

SEQ ID NO: 41601 - DNA, 290 bp, Homo sapiens
gcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaacttctgtgtacataggtttatctcctattggaatattttctttatata

SEQ ID NO: 41602 - DNA, 469 bp, Homo sapiens
  misc_feature 433: n = A,T,C or G
tgtttttttattgttaaagagagagaagataatctttagcatgtggttatttagacctatggctttactatttccatttttgtaaagcagcctcttgccccttccttctcgtggcccagtggacattgcttatttaggagcactctcccagtggtgtgccacagcaagcctgtgctctgtcatcactccaagagtatattcatgcactgctgcttggtatatttgaaatcacatgaaggtatatgatgttgtttggggcaatgtgatttaatcctctgccttgttaagaatagactaggccaggctgggcgctgtggctcacgcctgtaatcctagcactttgggatgccgaggtaggtggatcgcctgaggtcaggagtttgagaccagcctggccaacatggtgaaaacccatctatgctaaaaatagaanaattggctggacgtggtggcaggtgcctgtgatctc

SEQ ID NO: 41603 - DNA, 343 bp, Homo sapiens
gcaaggactgtttccattgcacctgtctgcatcctgttggcgtgggctgctgtgacacgtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatag

SEQ ID NO: 41604 - DNA, 417 bp, Homo sapiens
  misc_feature 309: n = A,T,C or G
gagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggngactttttaactgtgatgacccagaaaatgtctgagaaagatactaaagaagaaatcctgaaagctttcaagctctttgatgatgatgaaactgggaagatttcgttc

SEQ ID NO: 41605 - DNA, 472 bp, Homo sapiens
gcttctcttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagtctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggt

SEQ ID NO: 41606 - DNA, 468 bp, Homo sapiens
  misc_feature 12, 415: n = A,T,C or G
gatcctcaattnatgtggtgatgaaattgccaggttgtctgatatttctttcagacttcgccagacagattgctgataataaattaggtaagataatttgttgggccatattttaggacaggtaaaataacatcaggttccagttgcttgaattacaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtactggggggttactagcangaatatttccaatttctacctttactacatcttttcaacaagtaactttgtag

SEQ ID NO: 41607 - DNA, 211 bp, Homo sapiens
  misc_feature 211: n = A,T,C or G
aatgtaaagagaaaaaatagcataaacttagaacatcttgaatagtaagatgttgaaataagtcaagtactcactattaatgttagttgattaaacttgcggtttaaagacatagatgttcagatttgactaaataattgacatcagctgaatattgttaaaaatagccacatctgggatacctctttttgtacctgaagattactagccn

SEQ ID NO: 41608 - DNA, 129 bp, Homo sapiens
  misc_feature 55: n = A,T,C or G
tcttaggtctagcagtaattgttttattaatttgggggctccactgttagatgcntatatatttatgattgtgatattttcctgttggaccaatccttttatcattatataatgtccctctttgtcttt

SEQ ID NO: 41609 - DNA, 283 bp, Homo sapiens
  misc_feature 121: n = A,T,C or G
taacacaatatgttaaattgttttctatattaggtttggataaactggcatgcttaattgcttctttctgttttacataataatctattttcttcaccagagtaaaatatattttaatggngtgaaaaattactcttatgtcaacaatcttattaccaaaactatgatttgttctgatttaacactagcaattaatgcttgcaccattaatttacagcctacagcactagttaatttagtcaataactctacctcaacataaacaaataggtggcttagctcg

SEQ ID NO: 41610 - DNA, 469 bp, Homo sapiens
gttttctgcttaatatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaat

SEQ ID NO: 41611 - DNA, 444 bp, Homo sapiens
atctgtagacatcttgagttgtagctgcagacggggaccagtggctcccattttcattttagccttttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctga

SEQ ID NO: 41612 - DNA, 382 bp, Homo sapiens
caagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttac

SEQ ID NO: 41613 - DNA, 472 bp, Homo sapiens
  misc_feature 303, 459: n = A,T,C or G
attggatgttttgttgacatctatcttaaagttaaaaaataatttctcagtaaatctgagtgagtatatctcctgtctttcacatggcctgctttctaataattgcattccttaggttttagtgtccatttagggatcggaaagtaaaagtgatgcatataaaggcaaaagaagtactaggcatataactgaaataccatggctctgtctccagggtttacttgtaactcacactcctaccctcttgttaggtggagggaatttgttttttgcgttttgttttttgttttttgtttttttggngggtaggaaaaggtaaaaaactatacctgtaagaggtagagtattctaccaaggaggaagatgttcattcagaactaattccatcagaaatcctaattagaaatattagctaccagtaacagataaaaggaggtaaccctttgttctcattctggncaatttcaggaag

SEQ ID NO: 41614 - DNA, 467 bp, Homo sapiens
catttaagaagcatcctctgccagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacattagattctat

SEQ ID NO: 41615 - DNA, 472 bp, Homo sapiens
  misc_feature 6, 112, 445, 447: n = A,T,C or G
gattcnagcaaatctgtcatcattagcatcaaaggaaaaacagcttttcgcttccatgaagttaaagactttgaacaactggtagcaaaactcaggctcagatgcggagcancttcaactcaatatcatgatattagcacagagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatgttgaaagaaaaaatgaaggaacagtcgtggaaaatactgtttgcagaatgtggacgtggtgttagtatgtttcgaaccaaaaagactcgagatcttgttgtaagagggattccagaaacattaagaggagaactctggatgcttttttcangngctgttaatgacatggctactaatc

SEQ ID NO: 41616 - DNA, 470 bp, Homo sapiens
  misc_feature 21: n = A,T,C or G
catttttctttataaaaattntagtaatcctgccaaatgtgcctattgttaaagatttgcatgtgaagatcttagggaaccactgtttgagttctacaagctcatgagagtttatttttattataagatgtttttaatataaaagaattatgtaactgatcactatattacatcatttcagtgggccaggaaaatagatgtcttgctgttttcagtattttcttaagagattgcttttaaaacaaataattgttttacaaaaccaataattatcctttgaattttcatagactgactttgctttagacgtagaaattttttttcttaataaattatcactttgagaaatgaggcctgtacaaggctgataacctatatgtgatggagatcacccaatgccaagggcagaaagcaaacctagttaaataggtgagaaaaaaaataataatcccagtgccatttgtctgtgc

SEQ ID NO: 41617 - DNA, 123 bp, Homo sapiens
taaacggcgggagtaactatgactctcttaaggtagccaaatgcctcgtcatctaattagtgacgcgcatgaatggatgaacgagattcccactgtccctacctactatccagcgaaactcca

SEQ ID NO: 41618 - DNA, 330 bp, Homo sapiens
  misc_feature 34: n = A,T,C or G
aactgtgcccgatgcgtgcccaaggacaaggccnttaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaat

SEQ ID NO: 41619 - DNA, 274 bp, Homo sapiens
  misc_feature 210: n = A,T,C or G
gtttttgtgtgtgcataaattcttctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgtnaatatttcactctcctctagctatccttgatgagcttctcactttaagaataaatgtgtttgat

SEQ ID NO: 41620 - DNA, 262 bp, Homo sapiens
atcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatat

SEQ ID NO: 41621 - DNA, 467 bp, Homo sapiens
  misc_feature 19: n = A,T,C or G
gatagcattcttcccggtnactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttattgttggtgcttctgtgaattaagttggggggttcatcatgagtcttaatgttctttgttgataaga

SEQ ID NO: 41622 - DNA, 466 bp, Homo sapiens
  misc_feature 460: n = A,T,C or G
attcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttangaaata

SEQ ID NO: 41623 - DNA, 470 bp, Homo sapiens
ataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaaccttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacga

SEQ ID NO: 41624 - DNA, 382 bp, Homo sapiens
cagggaaagtgagaattttaattttgaacatcaaagggacaataaaaaattaatatttcagatgaatgtgtcagactaggtttcatttttaaaacattggagtgaataataaaagataagcataagttataaatgtctctgcttttgttcttttccattttttgctgaaatccttaaaaagatgctatctcattttataccctttttttaaaaaaaagggaaattcaagttaattgaatcttgcatattacatatacaaatatcttcctgtctagtaatttctttattcacagagcatatagcaataatttgacatcatactttgatgtctgaaaacctatgcaggatgacatggagtaagaggggtataatttgtagaacc

SEQ ID NO: 41625 - DNA, 186 bp, Homo sapiens
caagaaagcacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacctc

SEQ ID NO: 41626 - DNA, 468 bp, Homo sapiens
  misc_feature 17, 51: n = A,T,C or G
ggaataccatccttttntagcatctatgtgttatcaattctcaaatctgtntttctcattatcaaaacgtaactctcaaattgttaaaatatgaatccataaattgtgaacatgggtcagaatttaatcagtgaggaagccagcaggattatgaagttgatttttatattgttccagatgctacaaggaagaaaatttatatacaacattataaagaattttgtccaataacagagtacattttcttatgagataataggcttaaaagacaatttagcaagagttttctcaagaagttcttattttagataagaggtaggattgaggcaggaaaatagggcctggaggcagggaacataaggccaattcacacttaagctatgacaggaaatatccttttcatagggtgtatgcagagtaaataactttgtaactttacttcttcctctccatttacatatggcatac

SEQ ID NO: 41627 - DNA, 125 bp, Homo sapiens
tgacaatttttcctttttctacactaaaacaatatgtgatatatttcccctcttgaagaggcaattcattaaactctcaaattttctatagaatcaagatagaacctttagatactccaactcac

SEQ ID NO: 41628 - DNA, 219 bp, Homo sapiens
  misc_feature 12: n = A,T,C or G
ataactacaatncctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaag

SEQ ID NO: 41629 - DNA, 471 bp, Homo sapiens
tattaaaaaaaactgaggctagaggtagagggaagatgacagataggagacagggctgacctgcagctcccactcggatgaatagaacagcatatggagacccacaccatggacttttgctccaggaaccaccacaggagtataccagaaaaactgaaagaaatcaccaatcctttgaaagcagcagcaggctgctgcaaattctgtgagactggcaaaaaactctggtgctgtctccaaattgccaccttctggctggaggccaaccaactcaggacattatagcaactcatgaaccaacaaccccactccaaggaaagagaagacaacagtgaattctgctgcctgcaacatcctggctagccagtgatcctgagtttgtccatgtgactgtcactggtactataaccagcattcgagaatgctagcacactaaacacttctacaaccaattacagagtctactttact

SEQ ID NO: 41630 - DNA, 388 bp, Homo sapiens
aacaccacccagtgtggagcagcccagccaagtcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctca

SEQ ID NO: 41631 - DNA, 220 bp, Homo sapiens
gtatccaatttatacaggaattacaagtgcagtctgattgtgaatccttgtcttggcttcttagccttgagagtttttaaaagttgaatgtgaaattccttatgaaaaagttccaacaaagccaaactttaaaagagcctatatgtggtcaatcactatttttgctgtactttatgcaaataatcaggccaaatataataaaactaaaacttattttgtg

SEQ ID NO: 41632 - DNA, 338 bp, Homo sapiens
  misc_feature 303, 331: n = A,T,C or G
caaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgntataaaaagcctgccatttttaatatgnggtttgg

SEQ ID NO: 41633 - DNA, 135 bp, Homo sapiens
  misc_feature 17: n = A,T,C or G
acagccccgctcccagnagtaaagaacgcgacttccacaaacctggattttttatgtacaaccctgaccctgaccgtttgctatattcctttttctatgaaataatgtgaatgataataaaacagctttgacttg

SEQ ID NO: 41634 - DNA, 471 bp, Homo sapiens
  misc_feature 33: n = A,T,C or G
gtctttaacatagtatccaaaagtaccaaaatnaatcacatcaaaatagagtttggctttcttatacaattcaagtggaatttatccaattatatttaattcaatacttttttggtaattgccttttcatactaatatttatatgggttataggaggtaaaagggtacttatcaaaatataaattttatagtaattaatggcatttaatactatttttatcttcttaattttgtatacagtggttataaaaataatactaattttattacttttggtgttattattctaatccattctaagcataccatcaggatcacttgagtctcattctcataaaataagccgaaaaagtgtgccttgagaccctttatttgccaggaaaaacacattttattaactgctaattattgtcccaaatgtatatagttatatgttagcagattgtggctagccataaaattgtttttctc

SEQ ID NO: 41635 - DNA, 371 bp, Homo sapiens
gtctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttct

SEQ ID NO: 41636 - DNA, 437 bp, Homo sapiens
  misc_feature 32: n = A,T,C or G
gtatataaaatactagtaaagaaaaccccagnaagaaagctgggtagttttcagaagatacactgacttctctaggcttaatgacaaagtaagtactataataaatccaaactaacatttcagttttgaattcttttctgtttcctatacttctgttatattttttctttgttaatgagtcaaattcattctagttcataagaaaattaattttttaaataaatttttaaaataaaaatttttagcataaaaatgtgaaactttaaaattgccaacagaaatataaataattatcttgtgagtctgaaaaagatgtgtataagatcttttgaattattataaaattatatatgtctataagataatgaacaaaaacatatttaacatattgtattagtttcctattactgcataataaattaccacaaactttgttg

SEQ ID NO: 41637 - DNA, 167 bp, Homo sapiens
  misc_feature 151: n = A,T,C or G
atttggtaaaatgtgatatacatggtacatcagagatattgcatgcttggattttttggattttacagatacagcaacaatgtatttcattgatgtgaatgccttagagttatcttgagcaagaaactttatttttttttttgaaactccntctcaaaccaaaaacc

SEQ ID NO: 41638 - DNA, 465 bp, Homo sapiens
gtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaaga

SEQ ID NO: 41639 - DNA, 130 bp, Homo sapiens
tcaccaccatagtatgttacagttggctgtggtcacaaaagtagttaattgtgtcagcacccaaataaacatctaacaggtttctcaacagaggaatccacagtccaattccacttcaattgatagaccc

SEQ ID NO: 41640 - DNA, 464 bp, Homo sapiens
gcattgaaggctatctgtgacaaggaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagacacaaagtaggaaacatcaaatcctaccctaatacaggcagaaggatacagcttgatgctaacactgcatgaatgtatggacgactttgtcatatttacatatgatgaattatatatttcttttacttttcagtgtctcctcagaaacaatcggcccagaaggttatatttaaaaagaaagtttctcttttgaatattgccacaagaataacaggcgggtggaaatctggaacagagtatcctgagaatctgcccaccttgaaggctacaattgaaaat

SEQ ID NO: 41641 - DNA, 474 bp, Homo sapiens
aggattcatctttcttttaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgcccccca

SEQ ID NO: 41642 - DNA, 298 bp, Homo sapiens
  misc_feature 295: n = A,T,C or G
gtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacangac

SEQ ID NO: 41643 - DNA, 414 bp, Homo sapiens
atctaaacaccagttactgtcaccagccctaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctcta

SEQ ID NO: 41644 - DNA, 470 bp, Homo sapiens
gaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgac

SEQ ID NO: 41645 - DNA, 281 bp, Homo sapiens
tctcggggtcgctgtcggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaattcg

SEQ ID NO: 41646 - DNA, 470 bp, Homo sapiens
  misc_feature 425, 464: n = A,T,C or G
agccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgaggggggatgtctaagtttccccttttaangtttcaacaaatttcattgcactttcctttcaataaagntgttgc

SEQ ID NO: 41647 - DNA, 290 bp, Homo sapiens
  misc_feature 14, 289: n = A,T,C or G
aattaaaaagaatnggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctcccaaattcataacagttctatttaactgaattaaataaccnt

SEQ ID NO: 41648 - DNA, 486 bp, Homo sapiens
  misc_feature 6, 19: n = A,T,C or G
cacccngggaaactcggcnttatggccggaagtataacctcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatat

SEQ ID NO: 41649 - DNA, 328 bp, Homo sapiens
  misc_feature 14: n = A,T,C or G
aaagaggtttaatnctaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcg

SEQ ID NO: 41650 - DNA, 255 bp, Homo sapiens
tccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcagg

SEQ ID NO: 41651 - DNA, 469 bp, Homo sapiens
ataactgagttgtagttaaaaggattttttaaaagattgggtatcaataagtaacagttagaggttttctagactcccctttatgtggctgaatgacagctgcacatcaggcaggtttcagactcttaaattacacccgttttcttgaccttgtcgcccagacttcagaatattttttgtttattagttaaatactattcagtaatttaaataccagaaaggttcattctttgaagattgtttccaggaagagaaaatggtaatcaatagagatgttacaataattttatatttcatatacatacatatgtgtgcacacaaacacacattctcctgagggtggctgtctgtaaactgtagcttcattgtatagcagcaacctttggaaattcactaactgatacacagcaaaggctctgttgcctggctagtcctacccacaaaactcccattcagcattttttctgtt

SEQ ID NO: 41652 - DNA, 322 bp, Homo sapiens
ataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaatg

SEQ ID NO: 41653 - DNA, 477 bp, Homo sapiens
atcttaactaattaatttgttacaaccctatttccaataaggtcacattctgagatcctgcgagttaggacttcaacataactttatgggggatacaattcaatccataacaggtggtcagggcctgaattaagtagagattatggcattaaggatgttgaaagctaatagctggcacgagaatctgaatgaagaatgaatggcgtccctacaatgggggtttgggacataatcccaaaagacaccatcctgaataccgtaaaccctattgtgaagatcctgaaagattgaaatcctgaaagtgtaaaatccccaaaattacaatctcaaagaatcaaaattccaaaaatataattatttttaaaaggagagttgagaaacatataaaaatgtgatagaatacaggcagtaatgacatacatatttttgcaagcataaaacagatatattaacagcagtaatacaggtataacattt

SEQ ID NO: 41654 - DNA, 471 bp, Homo sapiens
gtagacctgaagctgtggcagcgagaagccggcagttagttgtgcttctccagaaagggagctctgactggcatatttccatggctgctgcaagtaagccagcacaataaggtatttccatctagaacttgggaatattggaactgctgatatcagaaattgtatgtattcctctttgaatacctagcaccgagcctgggcctgagacctaacaggtgttcagtctctgtccctgcttatttaatgaagaaaggctggtcatggattcattccaaggcagataaaaatcggccctaaaaggagagagtgtgatgatcttaattgtgtcccacacaaaactcatgtgttgaagccctgactccgaatgtgatgatgtttggggatggggcctttgggagataattaggtttagatgaggtcatgagggtggggccctcctgatgggattagcactcttataagaagagacac

SEQ ID NO: 41655 - DNA, 218 bp, Homo sapiens
gtgataatgatattgtagttacataggagattgtccctgtttgtaggagatgcatgctgaaaaggttttgggggagtgaaaggtatacagtttaagtcgttcaggtggaaaaagtatatgtagatggaaataaagcaaatacagcaaaatgttactgatcattgatatagatgaagagtggtgtttattgtaccaaactttcaacttttctttaggtc

SEQ ID NO: 41656 - DNA, 262 bp, Homo sapiens
aagtggtgtatgtcttctccaagtctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgc

SEQ ID NO: 41657 - DNA, 469 bp, Homo sapiens
taatgcatcctttcgaccggccaagcacagagcttcctcagtttggaagtgatgacagtactagtgccttctcacaagtaatatttggcagatattttaagttaggtgttcacatttttggagagatggatttttagtccaagctttacagctgtgtgtaagatctttctcttttgacccactattgataagtccatatatgctattagtatatttactaatttatcaaatactatgctaatattagttagacaatagtcaaaatagatacggtccctgtcctcatggccctcttttaatcttacagataaggatattttttgacatgtcgtcttgagtttaaggtgataggttttctctagcctgtagtagagaacatcagaaatttacctatacagactttcttttgcctgacttatacacaaaagataatttttcaccgaagttgatctaatttacaaattgccgt

SEQ ID NO: 41658 - DNA, 467 bp, Homo sapiens
  misc_feature 343: n = A,T,C or G
ctttgcaaacacattattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattangataatgacacaatcaaatataaattgcaagatgtcacaggtgtgatgaagggagagtaggagagaccatgagtatgtgtaacaggaggacacagcattattctagtgctgtactgttccgtac

SEQ ID NO: 41659 - DNA, 106 bp, Homo sapiens
gtgaatagaaagcggaggatggtccatgggatgtggggtagaggtgattccaggaacacttttacattctgcaacagacacctcaatttccatgtttttgtgatct

SEQ ID NO: 41660 - DNA, 350 bp, Homo sapiens
  misc_feature 6, 56, 89, 148, 208, 295, 332, 349: n = A,T,C or G
gagcanccgggtgggaaggctcaagatggcgtgcttgttggagaccccaatccgcntgagcgtcctttcgagacatgaaaaatgctgtnattggaaacaacaagcagaaagccaatctcattgttttaggagctgttccaagattgtngtacttgcttcagcaagaaacctcaagcacagagctgaaaactgaatgtgcagtggtgtngggaagtcttgctatgggtactgaaaacaatgtcaagtctctactggactgccatattatccctggcttattgcaaaggactactgnccccagacctgaagtttatttgaagcttgcccttccnatgcctggggaccattnt

SEQ ID NO: 41661 - DNA, 345 bp, Homo sapiens
  misc_feature 344: n = A,T,C or G
gctttccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggnc

SEQ ID NO: 41662 - DNA, 326 bp, Homo sapiens
cgcggtggcgcgtgcctgtagtcccacctcagcctccaaagtagctgggactactggccctgctcatactattttttgtagagacaggcttccactatgttgcccaggctggtcttgaactcctggattccagcaatcctcctgcctcagcctcctaaggcgctgagattacaggtgtgagccaccatgcctggccttgtactccacgttattttaaaagttctttggtgtgccagttttctataagtgcctggttttgtagataatatttggtatatgcgttatgaagaaattgttcctagttgtatcatttttaacatagaaga

SEQ ID NO: 41663 - DNA, 397 bp, Homo sapiens
  misc_feature 8, 157, 314, 352, 358: n = A,T,C or G
catgttcntaaaatatacctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtncttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgngtaactaatgtaaaaaacacaaaattttataaaattgnacaggnttttaaaaactactcacaactagcagatggcttaaaatg

SEQ ID NO: 41664 - DNA, 153 bp, Homo sapiens
  misc_feature 22: n = A,T,C or G
gttaaacccgttacttgatttnggcagtagaaaatcagtgtgtttattttctatttaaacttctacttgaagatagggcttggtggccaggaaaaaaagggaagtttaaaatttgctttatcttgaaaagattggttgagtggagtagcagat

SEQ ID NO: 41665 - DNA, 192 bp, Homo sapiens
  misc_feature 191: n = A,T,C or G
tcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggng

SEQ ID NO: 41666 - DNA, 209 bp, Homo sapiens
aagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttccc

SEQ ID NO: 41667 - DNA, 470 bp, Homo sapiens
agtgataactttccttggagaggatctaagaaaagcccagatttcggtagccatctccctccaaatatgtctctttctgctttcttagtgcccattatttccccttctcctttcttctgtcactgccatctccttcttggtcttcccattgttctttaactggccgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaac

SEQ ID NO: 41668 - DNA, 471 bp, Homo sapiens
  misc_feature 17: n = A,T,C or G
aatgaaagaccttccgnataagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcaga

SEQ ID NO: 41669 - DNA, 106 bp, Homo sapiens
cgcagtggctcacgcctgtcatcccagcacttttggaggctgaggcgggtggatcattaggtcgggggttcgagacgagcctgaccagtgaaaccgcgtctctact

SEQ ID NO: 41670 - DNA, 473 bp, Homo sapiens
gtttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcatccgttacaagatgaggtctgtgtatgctcacttccccatcgacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaat

SEQ ID NO: 41671 - DNA, 393 bp, Homo sapiens
  misc_feature 6, 32: n = A,T,C or G
agctgncactcagtgtatgttgctatcagctnacttgaggtaataaccaaggtgggccctaggcagtttaattgtaaagtcggaaaaaatattccttttggcgtttattaatatgccccttcttctgcctgaccatgtccttctcctctgcaggcaatgctatcacaacaattctctagagacccagagctccccaaaaatgaactttactgacttcttctctcactggacagtgctgaattatctaggtcatttgttattcttttgtccatgaacaccattacctattaagtgtccatttccttaccactcagccaggtggtaaagatagttattaatgtatacacattaatgtgtaataatgacatagtgtcttatcttcataccttttac

SEQ ID NO: 41672 - DNA, 340 bp, Homo sapiens
  misc_feature 7, 33, 210, 336, 338: n = A,T,C or G
aattatntacagtacataatacttgaaaataantaactatgttactggtatatgtactgttatgctatactttttattgttattttatagagtattccttctacttatatttttaataagttaactgtaaaacagtctcatggagatccttcaggaggtatttcaaaagaatgcattgttaacaaaggagatgacagctccatgcgtggnattgcccccaaaaaacttccatggggacaagatatggaggaggaagacagtgatattatcctgaccttgtgtggccctagggtaatgtgtgtgtttgtatcttagtttttacacaaaatatttaanangt

SEQ ID NO: 41673 - DNA, 211 bp, Homo sapiens
  misc_feature 18, 32: n = A,T,C or G
cagtcctataaacacagnacttgaaatagtantttaaatgtccaaatacctaaatgcgctaaactggaggtaactatttctaggtagttggatttttgaaagtcatgatcagccacacaactgttttgtacatacttattttctcatgcacttttctgtatgcaaataaagctataaatttactcatttcaataaactggagtggcagaac

SEQ ID NO: 41674 - DNA, 118 bp, Homo sapiens
  misc_feature 62, 80: n = A,T,C or G
aaaaagttgagaagccagatactaaagagaagaaacccgaagccaagaaggttgatgctggnggcaaggtgaaaaagggnaacctcaaagctaaaaagcccaagaaggggaagcccca

SEQ ID NO: 41675 - DNA, 371 bp, Homo sapiens
gaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgaga

SEQ ID NO: 41676 - DNA, 133 bp, Homo sapiens
gtgaaacaaatggtgagaatttgaattggtccctcctattatagtattgaaattaagtctacttaatttatcaagtcatgttcatgccctgattttatatacttgtatctatcaataaacattgtgatacttg

SEQ ID NO: 41677 - DNA, 375 bp, Homo sapiens
atgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcatttt

SEQ ID NO: 41678 - DNA, 100 bp, Homo sapiens
  misc_feature 23: n = A,T,C or G
aaattgtggtcttaatctcaggnatagcaagtaaagagaattgtacatgaaagtatttacacaaagttcccaaagccctgtggattatgcattagtttag

SEQ ID NO: 41679 - DNA, 254 bp, Homo sapiens
  misc_feature 6: n = A,T,C or G
gaagtntgttttatcacttttgaccttaaagatttcagacatgctgaaactgattgaagtatcatttgctaccagatagattagttatctctagttgtaggagtgggtacatctttaatggtatattctgggttattgtcttatttttgatgtaggtattctatcaacaatttattaaacctggcatccttgggtgagcatggatttttcaactttggtgttatattgtgtttgctttcaaaaactgcttttga

SEQ ID NO: 41680 - DNA, 281 bp, Homo sapiens
agtgcagaaagagaggacattaggcgagccagattccccagccacatgcgctgtggctgctccatgccaggtgccaggctaggtaccccatccaggggccagaggttgctgtttttcatccatgcaccaggaagagttcagacatcctgtgtaggacacactgggaagggaagtcacctgcatcgggaaaaccaagaagggaaccattataatatttgaatggccatgtgacatgggcctgattaaagaagaaaaaaggagtggatgatggaaataaatga

SEQ ID NO: 41681 - DNA, 195 bp, Homo sapiens
caagtgtgcccagggctgcgtctgcaaaggggcatcggagaagtgcagctgctgtgcctgatgtgggaacagctcttctcccatatgtaaatagaacaacctgcacaacctggatttttttaaaaataaaacactgagccatttgctgcatttctttttatactaaatatgtgactgacaataaaaacaattttg

SEQ ID NO: 41682 - DNA, 470 bp, Homo sapiens
aacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatgggaagtctacaacaaacacataaaacagattacactaagagctgagaaattcaaaggaactgaagattctgagagataaactgttcaagccttagcaatgatactgcacttctctttg

SEQ ID NO: 41683 - DNA, 337 bp, Homo sapiens
aaaaagcactcctatgtgacagtgcaaaatggtgcaaccattggaaaggggtacttgacaataacaaagttatatatacatttacccattcacccagcatttccacatctaggaatttgccctgaagatacacctttgacagtgctaccatatatatgcacagccattgcagtattacattttctggtaaaatattgtgaaatacctgaatggccagatatgggagattgttaaatcacctttggtgttgttatctgtcaaaccacatgaggaagacctctgtgcactaatatgaagtttttctcatatataggtgaaaaaagcaaagtgcaaaaga

SEQ ID NO: 41684 - DNA, 282 bp, Homo sapiens
ctatagtaatgatattgaacatttcttctatgcttactttctttggcatcatatctgttcaggtcatttatgcacattattaattgggttgttttcttgctgttgagttttgagagttccattatgtattttagatagaatcctttgtcagatgtatgatttgcaaatattttctcccagcctgtagcttgccttttcattcctttaacagtatctctcatagagcaagtaatttcagttttgatgaagtacaatttatcaatcttttctttcatagattgt

SEQ ID NO: 41685 - DNA, 331 bp, Homo sapiens
  misc_feature 7, 331: n = A,T,C or G
agaaatnagcccatactgcaaccaactgatctttgacaaagtggacaaaaataaacaatggggaagtggcactctattcaacaaatggtgctaggaaaatggctggctttgtgcagaagaatgacactggacccctgtctctcaccatatacaaaaattaagatggattaaagacttaaatataagacctgaaactataaaagccctggaaggtaaaactcttttggatattggcctagacaaagagtttatggctaattccccaaaagcaaatgcaactaaatcaaaaatagacaaatggaacttaagttaaaaagcctctgcacagcan

SEQ ID NO: 41686 - DNA, 131 bp, Homo sapiens
ataccaaaggtgctacatctatgtgatgggtggggtggggagggaatcactggtgctatagaaattgagatgcccccccaggccagcaaatgttcctttttgttcaaagtctatttttattccttgatatt

SEQ ID NO: 41687 - DNA, 420 bp, Homo sapiens
acgaacacgtgacgcggtcgggcggaccactgcagactgagcggtggaccgaattgggaccgctggcttataagcgatcatgtttctccagtattacctcaacgagcagggagatcgagtctatacgctgaagcagaaatttgacccgatgggacaacagacctgctcagcccatcctgctcggttctccccagatgacaaatactctcgacaccgaatcaccatcaagaaacgcttcgaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttg

SEQ ID NO: 41688 - DNA, 312 bp, Homo sapiens
catcacagtatgcagagtacttcctcacctttcatatctagggaccacccccgatgcattggtgagggtgggcacttataaatgcctgctattgttaagccattccagcctcttcctctgaatagaccagacaccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatg

SEQ ID NO: 41689 - DNA, 401 bp, Homo sapiens
  misc_feature 40: n = A,T,C or G
cagaatgaatatagacactgtatctaagtgggaccaaagnaaaaaatagcgaactttcaccaaagttttcatgaaaacccaaaagctttaaaagttactatcaagaaattgaaaggaaacccacagaataggataaaatatttgtaaatcatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaggatttgagtagatgtatctccaaagaaga

SEQ ID NO: 41690 - DNA, 124 bp, Homo sapiens
  misc_feature 67: n = A,T,C or G
tagggtggctcacgcctgtaatcccagcaccttgggagaccgaggtgggaggatggcttgagcctangagttggagaccagcctgggtcatacagcaagactctgtcactattttttaaaaagc

SEQ ID NO: 41691 - DNA, 362 bp, Homo sapiens
cagtatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgat

SEQ ID NO: 41692 - DNA, 255 bp, Homo sapiens
aaaacaggaatgtttggatggactgagatgaagtatataggcctaggaaatctggggaccaaaatggtatcggttacttaatgaggttagagactgcggtttctacttcaagttcaaatgccttgctaattacaagattcttattatttggagtttgtaattttaaaaggaggtggccatgtaactgaagttctctagtctaatgtgggaagtgttaagtgcagttatagacaaagtctatgaaagtgtagaaga

SEQ ID NO: 41693 - DNA, 383 bp, Homo sapiens
atcctcatgatcctgagaggtaggggaggaaccaggcccttctcccagatgagacaactgatctacagagagaacaagtggcttgcccacataagactgtgttttgtattacttattattcacttgtccatgggaaatgaacctggctatcaagtttttaatgaggtagatgatgaagttcatgtatggggttcgtgctaacattctggagaacaggttgagccttccctcaatgcagggaaagaagtgtgagaaacatgaagctgcaaaagagagcagctcggtgacaatcaatagtggccttttctatcactaggtatcccttgagcaccaactatatgaaaggcctagtgctggacactgcaaagtgcacaaagaaacat

SEQ ID NO: 41694 - DNA, 373 bp, Homo sapiens
  misc_feature 26: n = A,T,C or G
gtacttcatactgcttgtgccctggnacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttatgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggctacaatacaggtcagagacaatggcttat

SEQ ID NO: 41695 - DNA, 250 bp, Homo sapiens
  misc_feature 33: n = A,T,C or G
aacattcaaaatgacagtactccccagttcatntacagattcagtgcagtctctatgaaaatctcaactgcttttctgcataaccccataaactgatcctaaaattcatatagaaatacaagagatccaaaatggtcaaagcagtcttcaaaaagagaagcaaatttggaggctgaggcaggtggatcacaaggtcaggagatcgagaccatcctggctaacacggtgaaaccccatctctactaaaaat

SEQ ID NO: 41696 - DNA, 399 bp, Homo sapiens
  misc_feature 13, 20, 33, 50: n = A,T,C or G
cggttcttatggnccggggnccttttcacaagnatggcgccgaaagcgantaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggcc

SEQ ID NO: 41697 - DNA, 247 bp, Homo sapiens
  misc_feature 1: n = A,T,C or G
nattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacat

SEQ ID NO: 41698 - DNA, 410 bp, Homo sapiens
atagctgttctagatatttgagattagggttgaggcaaattgttgacatataattaaaatgtattttataactaaaatttagaagaatggaaaaagtttacattgtatttataagactttgctaacatgctttatgacattacggagaagtactaggaagaaggagatctttaaaaggagtgatattctgtttgctttgctggagtaccttatcaggaaatttgaaatcttagccctttaattgtgatatctgttaattctaaaacttacactgaatttaactttgaaggtcaacatatggatttttttaaaaacaatatttactctatcaaaagattagttgtatttttgacttgaggaaatagcttaatctgaacagcacgaaacttgacaaaaaagtttgctaatac

SEQ ID NO: 41699 - DNA, 269 bp, Homo sapiens
aagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaac

SEQ ID NO: 41700 - DNA, 428 bp, Homo sapiens
ataatggagctgaaaaattcctattgcctagtgaagtcatagctgccataatgtagtgcaacacattattcatgcttgtggtgatgctggtgtaaacaaacctacggctctgccagttagataaaagtatagcatatagaattatacatataatacataatacttgacagtgataattatattattgatttatgtacatgctctactttttatcgttattttagagtgtacctcttctacctattaaaaaaaggttaactgtaaaacagccacaggcaggttcttctgaaggcattgcagaaaaagacattgttatcatataaggtaacagcttcatgcatgttattgcccctgaagaacttccattgtgacaagatttggaggtgaaagaaaattatatttgatgaccctgattctatgtagaacta

SEQ ID NO: 41701 - DNA, 258 bp, Homo sapiens
  misc_feature 24, 27, 177, 178, 180, 236: n = A,T,C or G
taggaatctctttgcagggaactnccncaaaattaatgtcaaaataagacattaaaggaggaacatatgcagcagaaaaaagaggaggaagaagttcttaaagaagtaactgcacatttccaaattactttaactgaaactcaagcccagctggaacagcatgaaatacacaatgcnnanctgcggcaggagaacatggaaatgggagaaaagctaaagaagctcactgaccagtntgcactgagggaagaggtaaac

SEQ ID NO: 41702 - DNA, 328 bp, Homo sapiens
gcttttcgctcaggcccgtggcgccgacaggtatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaaaccaaacagccaaattctgccattaggaagtgtgtaagggtccagctgatcaagaatggcaagaaaatcacagcctttgtacccaatgacggttgcttgaactttattgaggaaaatgatga

SEQ ID NO: 41703 - DNA, 136 bp, Homo sapiens
attaatcccctggcccaacccgtcatctactctaccatctttgcaggcacactcatcacagcgctaagctcgcactgattttttacctgagtaggcctagaaataaacatgctagcttttattccagttctaacta

SEQ ID NO: 41704 - DNA, 286 bp, Homo sapiens
  misc_feature 252, 264: n = A,T,C or G
ctcagcacccgggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcanctgtccctgtancgacaggtctaaaaatctgact

SEQ ID NO: 41705 - DNA, 284 bp, Homo sapiens
gaaaaattcagttgacaaactgaaatatatatcaaagtcctctcaacagcaaagtggatcaagtagaagaattagtgagcttgaaaactggctatgtgaaaatccatagccagaggagaaagagaggaaaagaatgaaacacacttacaggactaaagagacctgagagaggagcttgaacaaacttcccaggtagcacttttcatctttttagcccactcctttcttcgtttttctttaagaactttgggacctacgtagttaataaggggaagggaaaatgc

SEQ ID NO: 41706 - DNA, 388 bp, Homo sapiens
actaccctgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaac

SEQ ID NO: 41707 - DNA, 401 bp, Homo sapiens
  misc_feature 25: n = A,T,C or G
cttggaaaaggcttcccctgtgacnaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatg

SEQ ID NO: 41708 - DNA, 406 bp, Homo sapiens
  misc_feature 7, 8: n = A,T,C or G
agatatnngcagaacaacctgcacggcgcagaaactaggaagcaagagatgacaagagtgacggcaagtttgaatcctgcttctgccactttccagtcacattgttggggatcctgtgagatacctaatgacaggcatttgcctctgggttctgagctaactgaggaagggacacaggcaatagagaaagcaccaaatattagttttatttccgacgaagatacactagagagttcaacccagaactgtgaggctttctaacacgaagagtgcttgaaagcccctttcccacctgcagggtagacactgaagtcatcagctacaaaagttactccctgcacttcctacttctcacctctgccactcctccaccccacaccagtcaagtgcctagagcggggaagga

SEQ ID NO: 41709 - DNA, 380 bp, Homo sapiens
  misc_feature 21, 260: n = A,T,C or G
agtctgcaggatggcaccggnacccctggttctccacatacgattctacttgtcaaattgcccaagaaattgctgagaaaattcaacaacgaaatcaatgtgaaagaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctctangatgatcttgtaactcgagagagactacttctggcatcctttaagaatgagggtgccgaaccagatctaatcaggtccagcctgatgagtgaagaggctaagcgaggagcacccaaccct

SEQ ID NO: 41710 - DNA, 381 bp, Homo sapiens
  misc_feature 6: n = A,T,C or G
aagttncttctttttaaatatttttttagaatttattttttaaaagcatatgtaactagtgatgattttagcattagctttacttggaggggagaagaaacaaaattacaccttaaactctattagatagactacaaaatggatttgatgtattcttacttttccaaagaattttttccacctggaataagaagagaggactagttgaaacatttgagctggagaggcttatgggcaatatgaagtgggccaaattcttgcaatacaccctattcaattgaaagtacagtgtctaaggataagaatacttctttaaagaccaacaattgttttaatgcaatcttaattagtaaatggtttacattttttctattgttattg

SEQ ID NO: 41711 - DNA, 271 bp, Homo sapiens
ctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaacagtgtctggcatgtagtagatgctcaataaacacttgttgaaaga

SEQ ID NO: 41712 - DNA, 383 bp, Homo sapiens
agattagacatgcaattattcctgtctttgctgctgatttcaattataactcattggaattatcagtccacaatagatgttccctgcctatgtggtgtttttaattaaacgttgacatcattctcacatgttcactgttattagcactgatggatgtaatcttcatgttttcctctgaacactgcatgccaagaaaggggccctctatcctcacggattttctaggcaagagaatatcaggccctcatctgtcatatttccatctcattcagcacaaaacaccctggctcatggaaactgcaagcatcgttgtcagctgcacctgcaggcaccacgggattgcaagtcagcataccctttcagaaatgaggatgaaatttaga

SEQ ID NO: 41713 - DNA, 123 bp, Homo sapiens
aattgactgcctatgcagtgccaagcatttctatgagaacttgaggatacaacactaaagaggaagatttaagttcttgtcctcatggagcttttatttggatgggggcgagataataagagc

SEQ ID NO: 41714 - DNA, 411 bp, Homo sapiens
  misc_feature 1, 73, 109, 112, 142, 146, 166: n = A,T,C or G
ntctactagaaactttaacacttaaaaacaagattaaattttaaaaaggaaacattgcacccaaaatctacanacgtggaatatcatgatataaaatttaaaatctggngantaatgaaacacaagattatggatagaactnaccncaggaaggctcagagtctantctccttccccaactaaactggtaaaatgacatttttgagaattctgttattcctaaatctgaagaatctttacctttttcttcttctgaacagaaatgagaaaaaactgccagggaccaaacaggtgaccaggactgactgacataaggaaaggttccaggatgttacaggatacgttgtgactaattcccagtacctgtgaatgcagccttatctggaaacacagtcgaggacaacttatgat

SEQ ID NO: 41715 - DNA, 116 bp, Homo sapiens
  misc_feature 9, 52: n = A,T,C or G
atttaaagnactatcatttgaaaatttgaaatttgtcagtgaattatatgancctttgctaagaagccactgaaagcattcatatgactgacttagcatttctctatcacaaaata

SEQ ID NO: 41716 - DNA, 253 bp, Homo sapiens
  misc_feature 11: n = A,T,C or G
gtgattttttncgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaagg

SEQ ID NO: 41717 - DNA, 368 bp, Homo sapiens
ggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaaatgagttctgtatgaaactgagatgttgtctatagctatgtctataaacaacctgaagacttgtgaaatcaatgtttcttttttaaaaaacaattttcaagttttttta

SEQ ID NO: 41718 - DNA, 142 bp, Homo sapiens
  misc_feature 18: n = A,T,C or G
gggaggggggagggatanctttaggagatatacctaatgctaaatgacgagttaatgggttcagcacaccagcatggcacatgtatacatatgtaactaacctgcacattgtgcacgtgtaccctaaaacttaaagtataat

SEQ ID NO: 41719 - DNA, 274 bp, Homo sapiens
ctctggctctttttggctcggggggggccgcagcggacgtgagcgataatggcggatatggaggatctcttcgggagcgacgccgacagcgaagctgagcgtaaagattctgattctggatctgactcagattctgatcaagagaatgctgcctccggcagtaatgcctctggaagtgaaagtgatcaggatgaaagaggtgattcaggacaaccaagtaataaggaactgtttggagatgacagtgaggacgagggagcttcacatcatagtg

SEQ ID NO: 41720 - DNA, 201 bp, Homo sapiens
  misc_feature 102, 168: n = A,T,C or G
agttccgagacgaccgatggagatggcggctgcggctgagtgacggactctggcctcccagatccccagctgcctcacttctctcttgagaacttggctcanggctcctgaggacctttcccagcattaccttcccttcccttgaaaggcacttgttggctgttttcntataagcaggaaaaataaacagaagtgtaaagg

SEQ ID NO: 41721 - DNA, 238 bp, Homo sapiens
aaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaaccc

SEQ ID NO: 41722 - DNA, 331 bp, Homo sapiens
atttcattatagtagaacaaatggattaagacacactgtaatgcactgcttcataaatggcattatattatcctattaattttgttgttaattttgctctttaaagaaatgataaaattggggccaggctcagtggctcacgcctgtaatcccagcactttggatggccaaggcgggtggatcatgaagtcaggagattgagaccatcctggctaacacggtggaactccgtctctactaaaaatataaaaaattagctgggcgtggtggcgcacgcttgtggtcccagctgctcaggaggctgaggcgggagaatcgcttgagcctggga

SEQ ID NO: 41723 - DNA, 148 bp, Homo sapiens
  misc_feature 7: n = A,T,C or G
gagaatngttggttcatttgtgggaaggttgcaggggggatctttgaatcacagccttcagatgccagaagggcagagggaatcccacacgggctggtggatcatgtgtgtgcatttctctcccttctaatctgaggaaactaagcgt

SEQ ID NO: 41724 - DNA, 323 bp, Homo sapiens
  misc_feature 1: n = A,T,C or G
ncgtattcgttgcttaactcgtttgcccttcatggtggaaaagactccttagtccgagaaatcacctccttggggtattcacttcttatgccttcaggaattgagattttccagttacaaatatataaactaaattttttagcctacctttttattacttaatatatttatctgtataatctgtgctgggcacttaagaggaaacacaactgactgtgactaaagtgtaaaagaagaaatacatttcatatttgccgtgtctaatgcagggtatgacatgtgtcttaagggaaagaagtttccgtggaggaggtggtatttga

SEQ ID NO: 41725 - DNA, 269 bp, Homo sapiens
  misc_feature 186: n = A,T,C or G
gtaatcctagcactgtgggaggctaaggcaggcggatagcttgcgcccaagagttcaagaccaacctgggcaacaggacaagacctcgtctctacaaaaaatttaaaaaattagctgggcatggtggcatgcaccggtagtcccagctatttgggaagctgaggcaggaggatgacttgagcccangaggctgaggctgcagtgaactgtgattgcaccaccacactccaggctgggcaacagagtgagaccttgtctcaaattaaatt

SEQ ID NO: 41726 - DNA, 449 bp, Homo sapiens
  misc_feature 7, 98: n = A,T,C or G
catgatncagaatgcaagcttctggtaccatgatcctcaacttagagaggaagaaaccaagacagagagcttaactcacttctctcagggaaaattangagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatga

SEQ ID NO: 41727 - DNA, 189 bp, Homo sapiens
  misc_feature 105, 126: n = A,T,C or G
aaggttgatgacaacaagaaactaggagaatgggtaggcctttgtaaaattgacagagaggggaaaccccgtaaagtggttggttgcagttgtgtagtagttaangactatggcaaggagtctcangccaaggatgtcattgaagagtatttcaaatgcatgaaatgaagaaataaatctttggctcac

SEQ ID NO: 41728 - DNA, 149 bp, Homo sapiens
ctcccgtgtgggcacctgggcatctgcattttgtgaaggctcccagattagtccaatgggaaggcaaggctgagaattggtgaactaaatgctgtcattccttctgcatcatgttacctgagggaagaagaattgagaagagagaaaat

SEQ ID NO: 41729 - DNA, 359 bp, Homo sapiens
ggaactcatcaccactatccctgccttatgacaaatgcttaaaggagttcttcaagcagaaaaaaaaggacaataattgctataatgaatacctagaaaagtataaaactagtgaggagtagtagtataaaactcactagtacttttattctttcatatgtatgagtacaggcaaacacatactcaaattcagaatactccaacactataatggtgctatgtgaatcattcatatctctagtatgaaggttaaaagtcaaaacagtcaaaaataacgaaagctaccataagtggttaaggaatacaaaatataaaaatatgtaagttgtgaaatcaaaaacataaattgtgtggggtag

SEQ ID NO: 41730 - DNA, 359 bp, Homo sapiens
  misc_feature 21: n = A,T,C or G
gggattgggacctggatattntggtggccatgactcagccaccacagcaagcatactggacttcattgtttagtacaggggtgtccagtcttttggcttccttgggccacacaaaatactacatttgtgcaaaggtagttgctgtttttgccattaaaagtaatggtaaaaacagcagttacttttgcaccaacctacattaacactaacaatagctaatgagcttttaaaaaaatgacaaaaatatctcataatgttttaagaaagttagcaaatttatgttgggccacattcaaagctgtcctgggccgcatgtggcccttgggccgcaggttggacaagcttggtttagtacattg

SEQ ID NO: 41731 - DNA, 276 bp, Homo sapiens
gaggaatgatgacaagaaaaggagtcaagaacaattcacagtatgagaagaaaaatggaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaatagc

SEQ ID NO: 41732 - DNA, 330 bp, Homo sapiens
aattagacttcgtgatctccgtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcttaaagtaagagttgggtcctttttttcttcaatacaactgtgctgtaccttgtaaagtattttatctgctgcttatttg

SEQ ID NO: 41733 - DNA, 334 bp, Homo sapiens
ggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttac

SEQ ID NO: 41734 - DNA, 285 bp, Homo sapiens
cagtctgtttaaataaatgaactcatctaaattaaaaaagaaagaaatttgaaaaaactttctctttgccatttcttcttcttcttttttaactgaaagccgaatccttccatttcttctgcacatctacttgcttaaattgtgggcaaaagagaaaaagaaggattgatcagagcattgtgcaatacagtttcattaactccttcccccgctcccccaaaaatttgaattttttttcaacactcttacacctgttatggaaaatgtcaacctttgtaagaaaac

SEQ ID NO: 41735 - DNA, 449 bp, Homo sapiens
  misc_feature 15: n = A,T,C or G
gatagtaaaaagatnttaaagtaagataaattctgcatttgaaaatactaaatgcaaaagaaagcaatagatttacaacaaagacatcagacttatagaaaacaaaaattaagatggcagacatgaatccagccatatcaacaatggtagtaagtgtgaatggattaaataacctaatcaaaggcagagattgtcagaatggggaggaaaaacaagatctatttatatgctctcttcaggggacacactttagattacaagataaaaaatagattgaaagtaaatgactgggaaagacagatcatgcaaacagcaatcacaagaaagttggagtggttatactgatagagtttaaaacaaagaatgataccagagataaagaaggacatttaataatgatcgtcaatccttcagtaggatataagaattgtaaacatatataccctaac

SEQ ID NO: 41736 - DNA, 387 bp, Homo sapiens
actcttaaaaatgctttgtgtgtattagcttactttatcttagtaactctatgaggtaggatgaccctatgatttattgttcaagccaggatacttttgaacgtgaaagggattgcttcttggccttttggctaagatcaagggaagagtgagggaaagggggcactcactgaatggcatgctgagataatagcagaaactaggactgtttgagagaaaggatgtgtgatgaccctaattaataccttctttttcagaagaaactgaagcatagggagaccaaataacttgcccactgcgcccagctggcctattcttttttattacagtcatgcattgcttaacggcgggcataccttctgagaaatgcatctttaggtgattttg

SEQ ID NO: 41737 - DNA, 295 bp, Homo sapiens
  misc_feature 240, 272, 281: n = A,T,C or G
catgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggggggcaacttccaatttaattctgctctgtccggcgcataggctgaattccaaaagaactttcttcctangatgtggggcttaaagcaccgtcatgtggggnggatcaaanaatcgctcctgtgg

SEQ ID NO: 41738 - DNA, 457 bp, Homo sapiens
  misc_feature 453: n = A,T,C or G
atccgggcccaacctgaaaacatcccagtcaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccangaat

SEQ ID NO: 41739 - DNA, 139 bp, Homo sapiens
  misc_feature 81: n = A,T,C or G
gggtgtgcagctctgtagaaaagctagaactaaagatagcaatgtggatgctctccatggagaagtgattgttgaggtcanggaggactggggtagacaaagcctgaggagaggatctagaggaatgtctacatttaga

SEQ ID NO: 41740 - DNA, 317 bp, Homo sapiens
ctgcccttacttactatctgtgagacctaggttgttactttaccgtctttgggactcagcttcctcatttgtaaaatgaagataccaggattgttgtgtggaataaatgggttaatgtatataaagtgcttggaatagtgtttggcacatcgtcgctttgtctaagtgtttgctgtttttatgcatttgaaggaataaaaaacattcatctttgaatttctctattaattcagtacacttgtaaaacaatgtctaagtactaaacatatattttcagtaatcacttgaccacatagaaatataaggaatgtgtttga

SEQ ID NO: 41741 - DNA, 136 bp, Homo sapiens
atctcttgtacaacgatgtgctttgaagatgttagtgtataacaattgatgtttgttttctgtttgattttaaacagagaaaaaataaaagggggtaatagctccttttttcttctttctttttttttttcatttc

SEQ ID NO: 41742 - DNA, 219 bp, Homo sapiens; identical to SEQ ID NO: 35737

SEQ ID NO: 41743 - DNA, 469 bp, Homo sapiens
ggaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaagggggttcaaacttcaacagaatgtggcaaccagaatg

SEQ ID NO: 41744 - DNA, 438 bp, Homo sapiens
aattcttcgttatgaaaaattttaaactcaaaagtagaatagtatcatggatgtccatgatccatggagtaaattaattataatacctacagttttttgggtattctgtacttgggcatgctttgaaaggcacattccgtgtattagctaatttctgtaatcctcgccacggcagtctataggtgctagtaccccattttgcagatgaaggtcttaagcacagagagtttaaacaacttgtttagagataccagcaagaatgtgatagagttagacttgaacctgggcagccttgcttcaggtgtcacagacttcattcaactgggtccaagacgagcaggtcccatgagtagagcctgctcagattgagacctgctgggtggccctatctgattaccccaatgaagtataggccctgaaaaagaaaggaaggggaat

SEQ ID NO: 41745 - DNA, 234 bp, Homo sapiens
cttcctaggaacaacatatgacgcactctcccctgaactctacacaacatattttgtcaccaagaccctacttctgacctccctgttcttatgaattcgaacagcatacccccgattccgctacgaccaactcatacacctcctatgaaaaaacttcctaccactcaccctagcattacttatatagatatgtctccatacccattacaatctccagcattccccctcaaacct

SEQ ID NO: 41746 - DNA, 146 bp, Homo sapiens
  misc_feature 6, 72, 100, 115, 130: n = A,T,C or G
caaccntggggaaggagccagtttgccggatacaaactggtgttctgttctggaggaaagggaggagtggangtgggctgggccctctcttctcaccttngttttttgttggagngtttctaataaactnggattctctaaccttt

SEQ ID NO: 41747 - DNA, 421 bp, Homo sapiens
gggcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtg

SEQ ID NO: 41748 - DNA, 169 bp, Homo sapiens
ggtgctgttggataccttacggcaagctgccgtccctgcccacccacctgaggacaggaacctccaactctgccttgccagaactgaccagtgtgtctgacagatggatatagaagacttagatcactacgagatgaaagcagagcccattagtgggaaaaagttggag

SEQ ID NO: 41749 - DNA, 464 bp, Homo sapiens
gaaccgatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacatgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtggtga

SEQ ID NO: 41750 - DNA, 152 bp, Homo sapiens
aattaccaggttatatagtaattctatcattaattttttgaggaaccaccatattatttttcacagtgacaggagcattgcacagtcccatcagcgatatacaagtttccaattcctccacatccttgccagcatttgttactttctggtgc

SEQ ID NO: 41751 - DNA, 258 bp, Homo sapiens
catgagtgaactcctattcacaattgctaaaaagagaataaaatacctaggaatccaacttacaagggatgtgaaggacctcttcaaggagaactacaaaccactgctcaacgaaataaaagaggacacaaaccaatggaagaacattccatgctcatggataggaagaatcaatatcgtgaaaatggccatactgcccaaggtaatttatagattcagtggcatccccatcaatctacaaatgactttcttcacaga

SEQ ID NO: 41752 - DNA, 431 bp, Homo sapiens
gctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttca

SEQ ID NO: 41753 - DNA, 110 bp, Homo sapiens
  misc_feature 89: n = A,T,C or G
cttaaagatgcccgtatctcttgcctcaataatctcacttaaaagtctatgccaaaaccgggcacagtgactcacgcctgtaatcctancactttgggaggttgaggcag

SEQ ID NO: 41754 - DNA, 363 bp, Homo sapiens
attttgagttaggagtaagaatgtggtataaaggagtagctcaggctaagaagaaacccaaaaatacatccaagaatctccacaagtagcagctgaaatgctctatttttcttttcttatcatcttcctgttgtatccaagtgctatctttcttccactttttatacttgtatccagaatttccagatttgtgtcttttttcttgggtgagcttcctagaatgaggattctgactcaattctaatccaattcagtggaaataattagatccaattcaattcatagatttaaagcattaaaaatctgccctctttacagaccacactcccacaagatgctgaaccacctggccaatggcagtac

SEQ ID NO: 41755 - DNA, 111 bp, Homo sapiens
  misc_feature 9, 20, 22, 35, 85, 101, 104: n = A,T,C or G
gatctcatntatcctttacngnaagggtacctacngtacctgaaaacaacgatggcctggaaaacacttcccatttacctgttgntgctgctgtctgtttncgngattcat

SEQ ID NO: 41756 - DNA, 208 bp, Homo sapiens
  misc_feature 15: n = A,T,C or G
cgagaccgcctggcnacatggtgaaaccccatctctactgaaagtacaaaaattagccaggcattgtggcacattcctgtaatcccagctacttgggaggctgaggcaggagaatcgcttgaatccaggaggcgaaggttgcagtgagccaagatcgcaccactgcacttcaacctgggtgacagagtgaggcttgtctcaaaaaaac

SEQ ID NO: 41757 - DNA, 110 bp, Homo sapiens
  misc_feature 5: n = A,T,C or G
acatnaccacaagtattattaccctcactgtcacccaacacaggcatgctcataaggaaaggttaaaaaaagtaaaaggaactcggcaaatcttaccccgcctgtttacc

SEQ ID NO: 41758 - DNA, 168 bp, Homo sapiens
ctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgcc

SEQ ID NO: 41759 - DNA, 469 bp, Homo sapiens
ggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtg

SEQ ID NO: 41760 - DNA, 314 bp, Homo sapiens
agccaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaaga

SEQ ID NO: 41761 - DNA, 120 bp, Homo sapiens
  misc_feature 2, 9, 52, 88: n = A,T,C or G
cnaggtgcngtgttagggtgtcagttttacaaaataatgaagcaattagctntgtgattgagagttattgtttggggatgtgtgttgnggttttgctttttttttttaaactgttttaat

SEQ ID NO: 41762 - DNA, 359 bp, Homo sapiens
gtagtatgtagttgcactttttttctgcctaatgtaacgtagcttgccccgtcaaaaattcaattaaaattcatggccagcaatcctgttccccctcagcatcctgatttaattttcctgttgcttttgcttgcttctccatttaataattactgaactttatgcatgttgatctatattgattttcactgcagttgaatgaacaaattatttcagtgtgacagccatgactcaagttccaattagtctgaaaagggtactttggaattgtcccatattaatcagagatggcaaaagaaaaagttctcatattaccaggttgattttgtgtctcatttcaaattttaatttaaaattat

SEQ ID NO: 41763 - DNA, 164 bp, Homo sapiens
cgtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttcc

SEQ ID NO: 41764 - DNA, 219 bp, Homo sapiens
tgataagagttgtcccaaagggtcgcttaaggaatctgccccacagcttcccccatagaaggatttcatgagcagatcagggcacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 41765 - DNA, 361 bp, Homo sapiens
gagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttg

SEQ ID NO: 41766 - DNA, 372 bp, Homo sapiens
ggaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaggtcaaagaagcataaaaagc

SEQ ID NO: 41767 - DNA, 322 bp, Homo sapiens
atcccaaaggtagcggcccatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaaggtggcttttgctttata

SEQ ID NO: 41768 - DNA, 314 bp, Homo sapiens
  misc_feature 116: n = A,T,C or G
gacagccctggtttctctgaaggctggactaattcatcagatcaactctaagtgatttccagggaaccttcatgactgttggaattgctccgtcataataagtcagggatatttangaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgatta

SEQ ID NO: 41769 - DNA, 262 bp, Homo sapiens
  misc_feature 200: n = A,T,C or G
gatacagacatgcagtgtgtaataaatacatcatggaaaatggggtattcattctttttgttacattctagttgtactcttttatttatttatcttttttcatgtaatcttgctccttctaacacttacagtcttctggttagatttgtctatcatttttgtgtaaatattacactttaatatagctttataatatattntaatatctgataggccaagtcttcttcctcactgcacccacacacattattcctcttttctt

SEQ ID NO: 41770 - DNA, 348 bp, Homo sapiens
cagaaatgtggagcctttgtagatttcagtgcataaaaccaagccatgatttcctgcggtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctat

SEQ ID NO: 41771 - DNA, 304 bp, Homo sapiens
  misc_feature 14: n = A,T,C or G
ggatttttagtatnatcctgttgagttacatttagatataggtagatattcgaataagcacgtagcacattctgcttgtcctcacatccagatcatttctaggactaattctccaagaagcagtcatacatacacttgaatcttcagtttcttcagcacttgaatgtaaagctgtattgtcatatatcaagtactgagtgaagtgcctaaaactgtgctagttgacactactttataagctgtttgtgttgctggtggttttatatttagattccaactagattgttattctggcatcttggga

SEQ ID NO: 41772 - DNA, 369 bp, Homo sapiens
  misc_feature 26: n = A,T,C or G
aagcctaataaagagagctcttaatngctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgaacccaagattttgaggctgcagtaagccataattgtaccactgcactccagcctgagcgacagagaacaagaccctgtctcaaaaataaagtgggggaaggggtgcaaaattacactgtgagaagccaagaagtttcaaagttctatttatttttctaagtcatttttaatcattat

SEQ ID NO: 41773 - DNA, 128 bp, Homo sapiens
  misc_feature 98: n = A,T,C or G
aagacaatgggactgatgtcatcttgagctcttcatttattttgactgtgatttatttggagtggaggcattgtttttaagaaaaacatgtcatgtangttgtctaaaaataaaatgcatttaaacac

SEQ ID NO: 41774 - DNA, 229 bp, Homo sapiens
gtttggacacttttcttgcaaatccttgaccgtgatgtaggatttatttttggactcagttctgatctattgaactatgtgcctatctttataccaatatgcctttcttgactaatgttaatgttgctttatagttagtcagtctttcgactttcttctttttcagaattgttttggctattcagagtcctttgcatttcatttaaattttggactcagcctgtttcta

SEQ ID NO: 41775 - DNA, 162 bp, Homo sapiens
ggacctgagggagcttactttgcctgtctccttccttggccatctctggtgaactgctggcccatctttttgctctcaatggagctttacttaccaccaaaatcttcattatttttgagaatgacttctgcctacccccaagctttattggggtattagtga

SEQ ID NO: 41776 - DNA, 203 bp, Homo sapiens
gtcctacagtctcttacatttagaccttcatggtagggtgatatgagtgctaaaaaaatttctttctagtagccaggaaacagatagataagataaaaacaaatgttccagatttaagacttcttaggatgagtacaaggaagagagaaatagtatggaaaggacattttttagcaatttataattttaaaatggaatttgcg

SEQ ID NO: 41777 - DNA, 278 bp, Homo sapiens
  misc_feature 16: n = A,T,C or G
gagtaaagtagttgtnagaaaataaactgaatgataggtaggaaagcttcaaactattaagtaaatgctgtgctttaaagttagggttagtagcctgaacatctggatcctggagtgctttcaagctctttgctgagaacatttctagatttcagtgttgtctggttagcagaatcttttctcggacagccatgtaacaaagttgtctatcttttgaaaactccaaactactaaagtgttggaaacctgaaatgctttgctttgaaggtaagatgact

SEQ ID NO: 41778 - DNA, 277 bp, Homo sapiens
  misc_feature 40: n = A,T,C or G
atcgttatctggaggcaacttctggtggtttttttttctnacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgc

SEQ ID NO: 41779 - DNA, 255 bp, Homo sapiens
  misc_feature 242, 244: n = A,T,C or G
tgtggttgctcacacctgtaatcctaactcttcagaagcccagggtgagcagatagcttgagctcaagactttgggatcatcctgggcaacacggcgaaaccctgtctctacaaagaatacaaaaattagctgggcatggtggcacaggtagtcccagctactcagatggctgaggtgggactacctacctgtagtcccagctactcaggtggctgaggtgggaggatggcttgagcctggngnagggtggggag

SEQ ID NO: 41780 - DNA, 498 bp, Homo sapiens
  misc_feature 14: n = A,T,C or G
ctgggaattcggcnttacggccggggctcttagtctaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattgcctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggtcaccttgttgagctccagtctatgagctcgtcagtagcagtacaagccatcactgggaattttaaatctcttcaagctaaattagaacggcttcattaattactgtgatatactttcatccgt

SEQ ID NO: 41781 - DNA, 308 bp, Homo sapiens
ctataatgaaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagac

SEQ ID NO: 41782 - DNA, 178 bp, Homo sapiens
aatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgaaatgatgagatgaaatgaagtgaaatgaaattagatg

SEQ ID NO: 41783 - DNA, 157 bp, Homo sapiens
agcgtgagaccccatctatgcaaaaaaaccaaaaaattagccaggcatggtggtgcatgcctgtgatcccggctacacgagaggatgaggcaggaggattgcttgagcccaggagttcaagaccagcctgggcaacaatgtgaaaccccgtctctac

SEQ ID NO: 41784 - DNA, 248 bp, Homo sapiens
  misc_feature 61, 127, 143, 197, 222, 248: n = A,T,C or G
tgctcggcaaaatttccctaccactgtcatcagtcagcagcctggtatgatgtgtcatcangaagttatgacaaagcacttcgcttcctgggatcaaatgatgaggagatgtcctatgacaataatnccttttatcaaaaacnctgtttgatgggttggcctccaaaaaggcttgaaaaaccggccttgaatcattnccccaaattggccaggccccttggngggggctgaacaaggccttgggggan

SEQ ID NO: 41785 - DNA, 328 bp, Homo sapiens
  misc_feature 322: n = A,T,C or G
cacagaagcctgaataatggattcatttacataattaaagaacacattcatagtggtaacactataatgaaagatgagaaagattaacacaaagttcaccctagtgtttacctatgggtaataaggggactgtgaggtagggtagaaagaaggtacacaaaggatctctacagcactattaatgtttcacttcttgagctggggctagagatctgggtaatcatttcatttttattttttaaactacatataagctttgtacacttttggatattagaacttcaataaaattataaaaaagagaaacagggaaaaaagtatnattgtc

SEQ ID NO: 41786 - DNA, 339 bp, Homo sapiens
aacgagaaactggactttttaaaccctcttcagagtcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctctt

SEQ ID NO: 41787 - DNA, 379 bp, Homo sapiens
gttggcgcttccggtggcctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgaggtaatttttaaagtctaaatgctgaatcattttaacctcaatactactggaggatgtttctgtataaataaaagtgtttaaaccg

SEQ ID NO: 41788 - DNA, 277 bp, Homo sapiens
  misc_feature 255: n = A,T,C or G
gtttctttaggggtggtctctggattagtaatatcagcatgccctgggaacctgttagaaatgcaggtgccagcctgggcaacttagtgagaccctgtctctacaaaaatttaaaaatgcaaggcggcacatacctgtagtcccagctacttgggaggctgaggcaggagaatcacttgaacccgagaggctgaggttgccatgaggctgcagcaagccaagattgtgccactgcactccagcctgggcaacagnagccggaaggacttctggtcct

SEQ ID NO: 41789 - DNA, 464 bp, Homo sapiens
  misc_feature 43: n = A,T,C or G
atcagcatcatgaccgagtcggagcgtgccccacctccagaangtatttgataggtacaagaagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtgggagatgacttgaagcccgacacggcctgagcgtccagaaatggtgctcaccatgcttccagctaacaggtctagaaaaccagcttgcgaat

SEQ ID NO: 41790 - DNA, 437 bp, Homo sapiens
  misc_feature 4, 18, 43, 63, 90, 92, 95: n = A,T,C or G
gacntgattggcccaccnttgtcactgtattactgctccgtcnctgcactggttcctcttccntctcaacttacctgttgccacttggantntantctcgcacacttactggtgccgagtggtaacatgggaagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaac

SEQ ID NO: 41791 - DNA, 473 bp, Homo sapiens
atatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagccgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaactta

SEQ ID NO: 41792 - DNA, 477 bp, Homo sapiens
ctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgta

SEQ ID NO: 41793 - DNA, 473 bp, Homo sapiens
gagatttagttgagatggactgcaagacagtgaccccagggctcaagtctccagtaaatgagggagagtggcaggttgctagatggcagtgaaggaaaggtgtaccgtttactgttgctaaatgacataggcctcagagaaataagtttttacatgggagatggtagagtaatggtctccatgtagcatcaaggaacaatgggatgtgggaaaataagcagtccccctttgagaagatggccgacaactgggaccctcgaaagagccacgttgctgttacgatgaggtggtatattatatcaatatcagcacaattaaatacagtttcttcccaaatactattttgtgcttttttaatttaaattttttatagcagcagattgttattttaaaaaaggaccacattctttttgaaatgtattttagactgtttcacttagacacatgtgaaaatatgtaaaattttgaatagc

SEQ ID NO: 41794 - DNA, 234 bp, Homo sapiens
  misc_feature 3: n = A,T,C or G
gtnaagtgctcttaccacaattttaaaaagttccctatagaaagtatttttaaaatgacagtttccctaacaccactgctaacattttgattgaaaaaaaatcattaatttgttcaataaacatttatcatacacttagaatgtgccaggttcagtgttatgcatgaggatgctacagcgaacagtttttctttctaggcatatgtccaacattatccatcagtcaatctatat

SEQ ID NO: 41795 - DNA, 103 bp, Homo sapiens
  misc_feature 23, 26: n = A,T,C or G
agttaaaatatgagccactgggngtnccagtgcattaatttgggcaaggaaagtgtcataatttgatactgtatctgttttccttcaaagtatagagcttttg

SEQ ID NO: 41796 - DNA, 473 bp, Homo sapiens
aggggaggaggaggagaaagaggagaaaagcattttggagggaaacaggctatatcaagagaaggaaacttaaaacagaaaaacctaaaagatgactgaagatacagaatccttgaaataaaaataagatgcctcccctcttttaaaggactaaacaggaaaggactcatagaaatttaacttgaaaaagttgggattgtttaaggtcaggaaatcaagactagtgtgggcaacatagtgagaccccatcttcacaaacaatttaaaaaatatattagttgggtgtggcggcacatgcctgtagtcctagctactcagttggctgaggtgggaggattgcttgatcccaggagttaaagtctgccgtgagttatgattgcaccactgcattccagcctgggcaacagagtgagaccttgtctctaaaaaaacataataatggaaaaagttaggtcataaatttgaaggtatat

SEQ ID NO: 41797 - DNA, 286 bp, Homo sapiens
  misc_feature 7: n = A,T,C or G
agatatnaactacagatccggaagctcagagagcaccaaagatggtaagtgccaaaaatctacacttagccacaccatattcaaacttcagaaaatcaaaggtaaagaaaccatcttgaaagaggccagggaggaaaaataccttacctatagagaaactaagataaaaattacatccaacttctcagaaatcatgcaagcaagaagagaatagtgaaatatttagtgttgagagaaagaagcccaccacctagaattttatatcctgccatgttgtgttaccctt

SEQ ID NO: 41798 - DNA, 144 bp, Homo sapiens
cagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagt

SEQ ID NO: 41799 - DNA, 468 bp, Homo sapiens
aaaactctgcctcagaaaagctgttgtgacagaaccagcaaaaggtgaagaggccttccagatgagtgaagttgatgaggaatctggattaaaggattcagagccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttttgttatcatttaatttgtaatttttcggtttcagaagcaaatattcg

SEQ ID NO: 41800 - DNA, 438 bp, Homo sapiens
aaataacatcaagtaacatctgtatcaggccctacatagaactacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggagga

SEQ ID NO: 41801 - DNA, 414 bp, Homo sapiens
  misc_feature 5: n = A,T,C or G
aagantactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaaggtttcaatcttggactttgaaaacaggattaaacgttagtattcgtgtgaatcagactaagtgggatttcattttacaactctgctctacttagcctttggatttagaagtaaaaataaagtatctctgactttctg

SEQ ID NO: 41802 - DNA, 173 bp, Homo sapiens
atagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggcc

SEQ ID NO: 41803 - DNA, 470 bp, Homo sapiens
agaacatatttttcttatggcacttgctatacgaagtgtgtttatctttctttctttttttttcccccctaaagagtacttagaaaagaaagaaaaaatgtaagccagtggaaaaatttactgaggtcaattgcctttctataacttgcaatcttgagaaaagatctggcctggggtgggggagggaaggagggatatatttctgagaggtggaaggttcatacagttgtttctgaattttggagaaaatagcaagaatataatgcttattgtaaaatgacattattaaacatatgaatgttcatttcttagaaaaatggctctttggttgaagattcatttctgctatcactgcttggtcaagatacagtggtggtgataagccatttatcttactgaaatgcctaaaacccaatatggtacatgtgagattttaaagtggagtgaaacttactttgtaaggtaacttt

SEQ ID NO: 41804 - DNA, 471 bp, Homo sapiens
  misc_feature 410: n = A,T,C or G
catgtccctacaaaggacatgaactcatcattttttatggctgcatagtattccatggtgtatatgtgccacattttcttaatccagtctaacattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatcnatagtggggttttgattttgcatttctctgatggccagtgataatgagcattttttcatgt

SEQ ID NO: 41805 - DNA, 479 bp, Homo sapiens
cacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgat

SEQ ID NO: 41806 - DNA, 278 bp, Homo sapiens
atgaaaataaattctagatgcatctgataagagttacctaataaagatctaattgtaaaaaacaataaaaatataggaaagtatctttattacactagggcagggaaggattttaaaaatatagaggaaaagtagtaataaaaaatactgacaaattttaccatatcaaaatgtaaagcacttctatgaagcaataaaatattgaaaaacaggttggatttttttaagtgttaagaatatataaataacttatacatcactaagaaaaaagacaaatg

SEQ ID NO: 41807 - DNA, 370 bp, Homo sapiens
catcaccacaaacatgtgagtatagtgttgtatgatgttaggacagctatgataggaaacttcccaggtgataggaaatttttaactccatgatcatcttatgggaccaccgtggtccgtcattgacggaaacaccattgtgcggcacatgactgtatttgtccatccttattgagtggttgtgagagttgttgggatcaagtgcctgagctctcagcacagtgactggcatgctggaggttttaatgatggcacttccgtgactcaactgccactctccttacatcagtcaagcttaagaagtattttcttcagattatgcaagtatactctagagttattgtattaaaaatcggtacaaatgggaaag

SEQ ID NO: 41808 - DNA, 199 bp, Homo sapiens
  misc_feature 119, 134, 146, 192: n = A,T,C or G
catggaagtgtgtccaggcttcaagtaacttgagttttaattttttttttttcttggcagagtaatgtaaaatttaaatggggaaagatatttaatatttaatactaagctttaaaaanaaacctgctatcatngctatgtatctngatgcaaagactatgatgttaataaaagaaagtccagaagagactnggcttcc

SEQ ID NO: 41809 - DNA, 217 bp, Homo sapiens
atctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctcttttttt

SEQ ID NO: 41810 - DNA, 481 bp, Homo sapiens
acccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgatcattacacaggctgttatttttctcaatacgaggcgcaaggtggactggctgactgagaagatgcatgccagagacttcacagtttctgctctgcatggtgacatggaccagaaggagagagatgttatcatgagggaattc

SEQ ID NO: 41811 - DNA, 312 bp, Homo sapiens
  misc_feature 311: n = A,T,C or G
attccttgcagagtaagatatgataagctcagttttagatatctcaatttgttagtagtatctgtagtgctcccagatagaaatattcactgggagccagaaatgcaggattggaatttgagagaatgtagagcttcaaaatcaaatgagaattagtgtgttagttctattatatcagtaagtggaagcttgtaatgaaggcagagcccagaaagtatgtcatagagctataagaggagaaggccaaggacagaacctaattaaacactagtattaagggacagtcaaaggaagagaaaattaagaaagant

SEQ ID NO: 41812 - DNA, 328 bp, Homo sapiens
  misc_feature 242: n = A,T,C or G
gtttctgtgtgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaagtaaacctggcagctntagaatacactatgtgcatttataatagctattttatatattgtagtatcaacatttttaaattaaatgttttacattcacaagcg

SEQ ID NO: 41813 - DNA, 206 bp, Homo sapiens
  misc_feature 10: n = A,T,C or G
cacgtgggcnaggctgtgtgagatgttggatgtttggtactgtccatgtctgggtgtgtgcctattacctcagcattactcacaaagtgtaccatgtagcatgttttgtgtatataaaagggagggtttttttaaaaatatattcccagattatccttgtaatgacacgaatctgcaataaaagccatcagtgctatttggatgtc

SEQ ID NO: 41814 - DNA, 326 bp, Homo sapiens
  misc_feature 6, 7: n = A,T,C or G
aacatnnttaatagctgagagtagagacttgagccccgcacctgactatagggcctttttgaaaggaaaattgacatcatcaaaattttaaatatattcagtctatttctcaaaaactcaaagaatactaataaatgtgtactcaggtatatgtacagaaattgctgtaacattataattttaaacaatttaaaacagactgagtttccaaagttagggtacaatgaaagaaaaggtggcttatttatactctggaatattttccaagagttgaaaaggatgaggatacacacacacacacacacacacacacacacacacacaca

SEQ ID NO: 41815 - DNA, 239 bp, Homo sapiens
gaggctgaggcgggcagatcacaaggtcaggagatcgagaccatcctggctagcatggtgaaaccccatctctactaaaaatacaaaaaattagccgggcgtattggcaggcacctgtagtcccagctactctggaagttgaggcaggagaatggtgtgaacccaggaggcagagcttgcagtgagctgagatcgcaccactgcactacagcctgggcaacagagcgagactccatccc

SEQ ID NO: 41816 - DNA, 426 bp, Homo sapiens
gcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttctcatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaagacg

SEQ ID NO: 41817 - DNA, 228 bp, Homo sapiens
  misc_feature 227, 228: n = A,T,C or G
attttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaccann

SEQ ID NO: 41818 - DNA, 344 bp, Homo sapiens; identical to SEQ ID NO: 35399

SEQ ID NO: 41819 - DNA, 475 bp, Homo sapiens
  misc_feature 358, 402: n = A,T,C or G
ctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggnccagtgttctgatttgggtctggacaaagtgccaaaggatcttncccctgacacaactctgctagacctgcaaaacaacaaaataaccgaaatcaaagatggagactttaagaacct

SEQ ID NO: 41820 - DNA, 301 bp, Homo sapiens
  misc_feature 7: n = A,T,C or G
acagagnatatcgacaaaagctggggaaaatagatggagaagaggataaatacagaaacacagagacacaaacatggaaagtaaagttccagaaatgcacagactcggggactcactaacacagggcatatggaaagaggcatatgcagatttatgaacatgcagaccctggaacacagagcctcagagacacccagacagaagaatacagagggaggcagtgtaagatggcggaatagaaggctccacctatcatcccctgccttcccctcaaggacaccaattaaacaactatctacac

SEQ ID NO: 41821 - DNA, 355 bp, Homo sapiens
cggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcc

SEQ ID NO: 41822 - DNA, 118 bp, Homo sapiens
  misc_feature 2: n = A,T,C or G
cnagtttatctttctactctagggctctgtaaggaagtaataaagaaaattaaattataatctttgcatttaggttctgggattgcaaatgtaagcaggtctaccattggcttttgca

SEQ ID NO: 41823 - DNA, 383 bp, Homo sapiens
gctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagcttcccagccgtgttgtagctaattaggaagcttgatttgctttgtgattgaaaaattggaaacctcttt

SEQ ID NO: 41824 - DNA, 202 bp, Homo sapiens
tatagtatttagcaaaattggattagcgttgaaagctatattacattaaaaaattatgatttttagactttaagccttggctaataagtaaataaatcaatttcctaacatctgatactttttctgaatgaaatggttgaatttataaccttgatgttcttgccacataatggattacattaaaaatatataatcttcttga

SEQ ID NO: 41825 - DNA, 384 bp, Homo sapiens
cgtgcgggggaggtggcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattaattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatg

SEQ ID NO: 41826 - DNA, 482 bp, Homo sapiens
  misc_feature 16: n = A,T,C or G
caccctctttaatttncaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagcttcttaaaagacttcagt

SEQ ID NO: 41827 - DNA, 472 bp, Homo sapiens; identical to SEQ ID NO: 26019

SEQ ID NO: 41828 - DNA, 269 bp, Homo sapiens
tgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacg

SEQ ID NO: 41829 - DNA, 247 bp, Homo sapiens
  misc_feature 34: n = A,T,C or G
atattaaatatggttttcacattagttatttgtnacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacatat

SEQ ID NO: 41830 - DNA, 379 bp, Homo sapiens
  misc_feature 368, 371, 373: n = A,T,C or G
agttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacanaancnaaaaga

SEQ ID NO: 41831 - DNA, 471 bp, Homo sapiens
gaacgctcattttacatgatatcaagaaccgaatgctagatagctagaatggttgttaacttcctagatatccattgtagaggaacacataaggtaaaacaaatgaataaaaattaaaaaaaaatgagatagccaaagatttgaagctctttacccattaacatgataatcatttcgactttgaatatttgtagaacaagagtcagaactcagaacaaagatctctgaggaaataaaaaaaaatcaagctgcctcctaatttctcatttagtctgtcattgggcattgtcaaactgtcaaactatatttagagattctggttttcatctggagacttagtgagttgtgtaatatcttgaatacacatataagatcttgccaggtggggtggctcatgtctgtagtcccagcactttgggaggatgaggtgggaggatcgctggagcccaggagttcaagaccagcctgggc

SEQ ID NO: 41832 - DNA, 161 bp, Homo sapiens
  misc_feature 12: n = A,T,C or G
gtgcttcaagcntcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccc

SEQ ID NO: 41833 - DNA, 436 bp, Homo sapiens; identical to SEQ ID NO: 39009

SEQ ID NO: 41834 - DNA, 392 bp, Homo sapiens
  misc_feature 73: n = A,T,C or G
cagcctcgtgttgaggttccagacttagaaacagacccctctgtacagggggattgtggtgagtgagaatcanggccaccttgtgtgttttctcactctcgaatgcaagtgggagagggaaaatgactcgggacgccattgtaacggttcctggaagctgggccctctcattggcatatactgtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgtttggattgcattactggcagaga

SEQ ID NO: 41835 - DNA, 477 bp, Homo sapiens
attccactgagccaccctacagccgaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgt

SEQ ID NO: 41836 - DNA, 424 bp, Homo sapiens
tggccgcagccttgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttggggaaattgtctttgcctgctgcctcgtgaagagtatcaagaagtggctacgaggtgatg

SEQ ID NO: 41837 - DNA, 269 bp, Homo sapiens
  misc_feature 6, 9, 143: n = A,T,C or G
atccanagnagtgcaaatgcacctcctgcaagaaagcagctgctgttcctgctgccccgtgggctgtgccaagtgtgcccagggctgcgtctgaataggggcatcggagaagtgcagctgctgtgcctgatgtgggaacagcntcttctcccatatgtaaatagaacaacctgcacaacctggatttttttaaaaataaaacactgagccatttgctgcatttctttttatactaaatatgtgactgacaataaaaacaattttgacga

SEQ ID NO: 41838 - DNA, 437 bp, Homo sapiens
  misc_feature 15, 20, 51: n = A,T,C or G
tattggcccggggancttgnagcaagtaggaggggcatcagctcgcattcnaggatgccctgagtacagtgttgcaatctgcagaaggatgtacctgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggtttttttgtggtcttgagtcacactgagatagtcagttgtgtgtgactctaataaacggagcctaccttttgtaaatc

SEQ ID NO: 41839 - DNA, 486 bp, Homo sapiens
ggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgac

SEQ ID NO: 41840 - DNA, 456 bp, Homo sapiens
  misc_feature 9, 19, 50, 61, 67, 83, 91, 108: n = A,T,C or G
gcttttccnaaccttggancgcccgcagtactgggcttcccgcaaagtangggtgggcganacgacnaagggccgttctgccntcaacganagtggtaacccgagaantacaccctcaacattcacaaagcgcatccctgggagtgggcttcaagaagcgtgcacctcgggcactcaaagagattcggaaatttgccatgaagggagatgggaactccagatgtgcgcattgacaccaggctcaacaaagctgtctgggccaaaggaataaggaatgtgccataccgaatccgtgtgcggctgtccagaaaacgtaatgagggatgaaagattcaccaaataagctatatactttggttacctatgtacctgttaccactttcaaaaatctacagacagtcaatgttggatgagaactaatcgctgatcgtcagatcaaataaagttataaaattg

SEQ ID NO: 41841 - DNA, 474 bp, Homo sapiens
gacccctgctcagtaaagcacttgcaaccatctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtg

SEQ ID NO: 41842 - DNA, 256 bp, Homo sapiens
  misc_feature 14, 15, 36, 46, 60: n = A,T,C or G
cgggaatttcggcnntttttggccggggggcggatnacttgaggtnaggagtttgagacnagcctggccaacatggtgaaacaccgtctccactaaaaatagaaaaattaactgggtgtggtggagggcgcctgtaatcccagctaatcaggaagctgagacaggaggatcgcttgaacccaggaggcggaggttgcagtgagccgagattgctccattgcactccagcctgggcgatagagtgagactcagccct

SEQ ID NO: 41843 - DNA, 440 bp, Homo sapiens
  misc_feature 11, 16, 29, 34, 51, 58, 68, 69, 93, 144, 160: n = A,T,C or G
accgtaaagcngggancccaagaccaganacacnttttaacaagcaagganaagtttncccttctganncacaacagttttaacaggaaaccnaaacttggactgcctctttcaggtctgtaaattgagtcgactactagaaantgtattttccagcctntcattgatgggcatttgggttggtcccatgactttgctaatataaatagtgctgtgataaacatacgtgtgcatatgtctttacagtagaatgatttttaatcctttgggtatatacccagtaatgggatttgttgggccaaagggtatttctggttctagatccttgaggagttgccacactgtcttccacaatggttgaactaattacactcccaccaacagtgtaaaagtgtttctgtgataaacctggattaaaaaaaaatacgtcacatgtacag

SEQ ID NO: 41844 - DNA, 264 bp, Homo sapiens
  misc_feature 7, 13, 17, 33, 34, 41, 85, 91, 92, 94, 125, 136, 143: n = A,T,C or G
cgccccntcacangacnctttgacctgtttganngttgacnccctgagacctctttgaagtactggctgactcctgcctcagcanttgtanncnctggtctttaaagtgccctggccctcctttntccttcagaantatttanttttactttacaatcctcaagttttaaattgattttaaaatatttttcaatacaacagtttaggtttaagatgaccaatgacaatgaccacctttgcagaaagtaaactgattgaataaat

SEQ ID NO: 41845 - DNA, 474 bp, Homo sapiens
aggaatgaagcattaaagggggtcttcatgttcatgaaatattcagtaggtagagaatctggagagcttagtaaaataataggctgaacacactgccttatttttctttcttttcagttgccctttgaaatagagctgatggtaattttgtcttccaagcctcaacgcgtattgaggacagattagctaaacacactggtctgggaatcaagagacctggttatcattcttgtcactacttactagccagatggccttcagcaaatcactttagacttcagttttctcttcttaaaatgggaagactgttacctctctaattccctcacaggcttggttgctaggaagatcaagttaactagtcagtgggctttggagaccagcaaacaagttacacacacacacgtatatatgtgtatgtgtatatattgcatggttctccatttatttaatcatgtatttctcttgaatgct

SEQ ID NO: 41846 - DNA, 463 bp, Homo sapiens
gggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaattaatatttccattaataacctattcattgcagatacctattatactgggtaacagttggtttggaaattttatgttaaaattaaaactatcagtatttttg

SEQ ID NO: 41847 - DNA, 499 bp, Homo sapiens
  misc_feature 2, 105, 481, 485, 487: n = A,T,C or G
tnttggccgggtgtcaccctctgaaaacttcccgacgtttactgttctctttgtttactcctcaaccactagaataaagcagacttgaaaataagcagtcttccnttccctagttgggtgagactatccgaaaagcctttgaacattttcttagtgaaatgaaagaggagtcctgttctctgcagtggaggatttggagacaagtggctcggcattcggctcttggaattttaacttaactactaattagcaatggctctctccagataacaaaccactaatggagtaagatatactaataatgggagaagacaataaataaacctatcaaattggcaaagattttgaaacgtcataatagcacatgttaaaaagaagaaatgagtactgatgggagtatgcaagctaaaactttgagaaaataatttaatcgtatgtatcaagattccttaaaaaaaaaaaactgttcatgtcttctagngatngnactctaaaaatt

SEQ ID NO: 41848 - DNA, 475 bp, Homo sapiens
attcttcggtttgcctcctcccagtggcgtggatttgctcccgacccgcttttggggcgtgcctgcttcctcctctctgttaggttcgactgattctcgtgcctcagcctcctcagtagctgggattacagatgagccccagagaggcgaagccacttgagctcgtgagtgacagtcagatgtcaagccctgctctttctaaagcgtgctgccttcaaaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggccctt

SEQ ID NO: 41849 - DNA, 500 bp, Homo sapiens
  misc_feature 8, 17, 28, 39, 55, 103: n = A,T,C or G
accaaatntctctgaantctgtaagccnactttcagctnttctggtttttctacnaccttctaccctaaattaaccaaaggactttttcttcagcgtattccntgtttcagcactaaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatggtggaaagttccttgtggtagccataccttgaag

SEQ ID NO: 41850 - DNA, 249 bp, Homo sapiens
  misc_feature 10, 21, 32, 33, 36, 38, 39, 43, 47, 51, 60, 72, 82, 96, 105,169, 182: n = A,T,C or G
aacctcgaancaagttttgancttgtgttttnntcntnnaccnaccnagangccttcccntctgtaagcctnaggagaagcnacccctccaccccntttgctcgnagtatccctaagaaatcttttgtgctctcgcttgcagttcccttttgggttccattgttttccnttgttccctcccntgccctagctggattgcagagttaaggtttatgaattatgaaaataaaaaactaaaataacaattgc

SEQ ID NO: 41851 - DNA, 239 bp, Homo sapiens
  misc_feature 9, 14: n = A,T,C or G
cttgttacnagaantgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatca

SEQ ID NO: 41852 - DNA, 446 bp, Homo sapiens
cgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctacatggttaaaagtagtcatggataactacattacctgttcttgcctaataagtttcttttaatccaatccactaacactttagttatattcactggttttacacagagaaatacaaaataaagatcacacctt

SEQ ID NO: 41853 - DNA, 319 bp, Homo sapiens
  misc_feature 12: n = A,T,C or G
gtctccggaacnaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggattcga

SEQ ID NO: 41854 - DNA, 469 bp, Homo sapiens
  misc_feature 467: n = A,T,C or G
caagcaggaagattctatatcctgatggtagaagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgaaangg

SEQ ID NO: 41855 - DNA, 257 bp, Homo sapiens
  misc_feature 25: n = A,T,C or G
agtttctttgttataatttaatttnaaaattaattttcttaccttttttctacttccttaagacttactctttttctgttttcctaaattgaaatgcttcatattgcattctgtttttcaattgctgtggatttatgttttttcaatgtattatttattatttattattctttttgaggcgggtggttcacctgaggtcaggagtttcagaccagcctagccaatatggtgaaaccccatctctactaaaaatacga

SEQ ID NO: 41856 - DNA, 199 bp, Homo sapiens
  misc_feature 42, 65, 67: n = A,T,C or G
taacacaatctagtaaaccagactgaaatcctaactctgaancgttttccagaagcatttcttananaaattcttttactaaaaagaaaaacaacacaacatctaagatttagaagtggaagaatatacttgtagttaacttccttgttgatttaaaaaatatatttggatttattttggcagggtgggggaatcatct

SEQ ID NO: 41857 - DNA, 470 bp, Homo sapiens
aacattgtggatgtgtaaacaggcaccactgctttaaaaaacaattatcccttacagacttgaacatttgcagacgttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatatattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaaaggtaactgat

SEQ ID NO: 41858 - DNA, 402 bp, Homo sapiens
  misc_feature 1, 35: n = A,T,C or G
natggcccgggggttgacccgggagaatcgaagangggggtgaaagctggagatatttcggatgataatctacctcactttccctgtggctatgttctgggtttccaatcaggccgagtggtttgaggacgatgtcatacagcgcaagagggagctgtggccacctgagaagccatgagtaaggaaccgagagcagaggagtagatggtttccttattgccttctcctggaagagtgaagcggatcccacgcggacccctttcttcaagagatagaggaattcaaagagaggttacggaagcggcgggaggagaagctccttcgcgacgcccagcagaactcctgaggcctccaagtgggagtcctagcccctcccctgatgaaatatacatatactcagct

SEQ ID NO: 41859 - DNA, 113 bp, Homo sapiens
  misc_feature 8, 16, 21, 22, 33: n = A,T,C or G
acctgacnacctcgtnaagannccacaccagantctccgtgcagcggactcaggctccagctgtggctacaacatagggtttttatacaagaaaaataaagtgaattaagcga

SEQ ID NO: 41860 - DNA, 469 bp, Homo sapiens
ctacaatgcaaacctttttcctggtacctagagaatatatatcctgattctcaaattccacgtcactatttctcattgggggagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagacc

SEQ ID NO: 41861 - DNA, 482 bp, Homo sapiens
agggtaaaaactgcctgactaacttcctggcatggatcttacccgtgacaaaatgtgttccatggtcaaaaaatggcagacaatgattgaagctcacgttgatgtcaagactaccgatggttacttgcttcgtctttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagc

SEQ ID NO: 41862 - DNA, 132 bp, Homo sapiens
  misc_feature 5, 31, 35: n = A,T,C or G
gatcnaggtgactctgacatcattagaagcntgcnagaacagactggtgaaaagtaaaccttttcacctacaaaatttcacctgcaaaccttaaacctgcaaaattttcctttaataaaatttgcttgttcc

SEQ ID NO: 41863 - DNA, 473 bp, Homo sapiens
  misc_feature 15, 41, 42, 81: n = A,T,C or G
attggtctctttgcngccctcccctttcccaatgaaaagcnntgtcaaattaatcactggattgactgcttcctctttttntttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatc

SEQ ID NO: 41864 - DNA, 497 bp, Homo sapiens
  misc_feature 13, 14, 24, 35, 388: n = A,T,C or G
gaactctccggcnnctattgggcncgggggaaagnaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggccgcatgaaggttttctttagaatcagaattgtagccagtttctttggccagaaggatgaatacttggatattacctgaaagggaggggtggagatggggtgtggcaagtgtatgggggggngatttttattttctttctttggtcatgggggccaaggagaaaggcatgaatcttccctgtcaggctcttacagccacaggcactgtgtctactgtctggaagacatgtc

SEQ ID NO: 41865 - DNA, 314 bp, Homo sapiens
  misc_feature 5: n = A,T,C or G
aatcnttttatttgttaataaaatgctgttatgtctgcaccatgtaaagcactttgcctggtgctgagataaacttcgcttacatactttacttgaaagcatatccattaacacttactgtatatttttttcttctgtgtcccctactttataatattttcatgatattgtctctgttataattctttctactgtatatgctcagtttataaacttcttgatgtcagaggccaagtcttatttgttttaaatccagataatatatgttaaattaatgaataaaagatgattttaaaagttctcagaaaacaaac

SEQ ID NO: 41866 - DNA, 474 bp, Homo sapiens
aacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaaca

SEQ ID NO: 41867 - DNA, 215 bp, Homo sapiens
  misc_feature 40, 51, 96, 123, 154, 171, 186, 200: n = A,T,C or G
atgctttttttttttaattattacctgatttaaaaatctntgtaaaaacgngtagggtttcataaaatccgtaactcgcattttaatgatcagctnttataagcttttaatagcatgaaaatngttaggctatataacattgccacttcaactntaaggaatatttttganacatccctttggaanaccttgcttggaanagcctggacactaac

SEQ ID NO: 41868 - DNA, 264 bp, Homo sapiens
  misc_feature 6, 7, 12, 23, 27, 29, 30, 31, 37, 38, 44, 263: n = A,T,C or G
aaagcnntgatncagaagacttnaatncnnncttttnntcctantaggcttaaataggaaagtttcttcaacaggattacagtgtagctacctacatgctgaaaaatattagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcnc

SEQ ID NO: 41869 - DNA, 470 bp, Homo sapiens
atggagggggagcctcagagctgacagtcctgcttagagcccttaaaaggacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttaggggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttctg

SEQ ID NO: 41870 - DNA, 482 bp, Homo sapiens
  misc_feature 11: n = A,T,C or G
agggaaagagngagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaaattggttagtttattgattgcagataaactcatgccagagaacttaaagtcttagaatggaaaaagtaaagaaatatcaacttccaagttggcaagtaactcccaat

SEQ ID NO: 41871 - DNA, 468 bp, Homo sapiens
agcagcaaaaagaagaataattgagggaatctgaaaaactattagaggctctgcgggaaggaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgc

SEQ ID NO: 41872 - DNA, 308 bp, Homo sapiens
  misc_feature 1: n = A,T,C or G
nagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattatgcaatgtgagcaatatttcctaccatacttcactcccaatattttttgagatgtttgtataaaatggaatttaaagttcacttatgattgtatatgaaccacagaggagcccatttattaataaaaaacttttttaatagttaaatac

SEQ ID NO: 41873 - DNA, 203 bp, Homo sapiens
  misc_feature 5, 9, 11, 12, 15, 16, 24, 49, 70, 79, 95, 104, 127, 166,172, 178, 201: n = A,T,C or G
gatanttantnntannaagacttntattatatgatttgattgaacctanacgcattaagtgaatgcgagntttacctanaacttgcggaaatttnaacacattnccctttacttactacacgacacngacctgatttttatttaaagaacacaatttggctttgcnagactnaagagnaaaggaagccataactgataaantg

SEQ ID NO: 41874 - DNA, 264 bp, Homo sapiens
taggagttatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaaga

SEQ ID NO: 41875 - DNA, 219 bp, Homo sapiens
  misc_feature 5: n = A,T,C or G
ctccnttctagtggattaatgcattttgctgcctttattagggtactttattttgcttttcagaagtcagcctacataacacatttttaaagtctaaactgttaaacaactctttaaaggataattatccaataaaaaaaacctagtgctgattcacagcttattatccaattcaaaaataaattagaaaaatatatgcttacatttttcacttttgct

SEQ ID NO: 41876 - DNA, 472 bp, Homo sapiens
cagttgacacaaaatagactacgaaagtggctttaacatatctgaacacacaatagctaagacccaaactgggattagataccccactatgcttagccctaaacctcaacagttaaatcgacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaaggtgtagcccatggaggtggcaagaaatgggctacattttctaccccagaaaactacgatagcccttatgaaacttaagggtcgaaggtggatttagcagtaaactgagagtagagtgctttagttgaacagggccctga

SEQ ID NO: 41877 - DNA, 472 bp, Homo sapiens
gaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgctttgatatcacagaggaaactctgcattctcg

SEQ ID NO: 41878 - DNA, 309 bp, Homo sapiens
tgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatac

SEQ ID NO: 41879 - DNA, 114 bp, Homo sapiens
cgcatgatcagtagctgcaccactagaaagatggcggagcaagaaaaatctcctgaaaaagaggaaggcttatcaagccctcaaagccacccaggcaaagcaggcacttttgac

SEQ ID NO: 41880 - DNA, 254 bp, Homo sapiens
  misc_feature 21: n = A,T,C or G
attgtgtgttatctgacaagnatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactg

SEQ ID NO: 41881 - DNA, 445 bp, Homo sapiens
ataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttcga

SEQ ID NO: 41882 - DNA, 200 bp, Homo sapiens
  misc_feature 3, 4: n = A,T,C or G
aannattatttacatttgtgctgtgcctcttttaccttatttgtaaaatagagcaagcacccaactcaagcagttgttgcaagaactgcctgctatgctgtttaatacagtatgtggcaaatagcaagtgggtaagtaaatgttaataatactgtttggattctcattttacatatgagaaactgaggtttaatgaagtt

SEQ ID NO: 41883 - DNA, 468 bp, Homo sapiens
  misc_feature 6, 416, 417, 460, 464: n = A,T,C or G
agaaantgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgggtttctggtttttcccagtatgcatgtttaaataannaaagtgaccaagaatcacatccgggttgtgtcctgtggggaangggncaag

SEQ ID NO: 41884 - DNA, 284 bp, Homo sapiens
gaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagatt

SEQ ID NO: 41885 - DNA, 467 bp, Homo sapiens
  misc_feature 34, 37, 42, 60, 66, 151, 166, 190, 218, 273: n = A,T,C or G
agacagcaagtgtcggatccgcaggcgcatccgngcnatgtngtcctctacagccatgtnttcggntcctggcagagacttggggatggaaccgcacagagccgcgggccctttgcagctgcgattttcgccctacgttttcaacggaggnactatactggcaatngctggagaagattttgcaattgtngcttctgatactcgattgagtgaagggntttcaattcatacgcgggatagccccaaatgttacaaattaacagacaaaacagncattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaag

SEQ ID NO: 41886 - DNA, 179 bp, Homo sapiens
aaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgg

SEQ ID NO: 41887 - DNA, 267 bp, Homo sapiens
  misc_feature 14: n = A,T,C or G
atctcaagcccagnaagagaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgattt

SEQ ID NO: 41888 - DNA, 405 bp, Homo sapiens
  misc_feature 14: n = A,T,C or G
atcgcacccccagnacgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgttctgggatttctctagaggctggcaaga

SEQ ID NO: 41889 - DNA, 295 bp, Homo sapiens
gaaagcaatgtatctcaaaataattagcaccatctgtgataaacccattgccaacatcatactgaatgggcaaaagttggaagcatcctctttaagaataggaactatcagacttagtgacatggtaaaaccccatctctacaaaaaatgcaaaaattagctgggcattgtgcctgtggttccattctacttggaaggttgaggtgggaagatcacttagcctgggaggcagagattacagtgagccaagatcaagccactgcattccagcctgggcagtgagacacagtctcgc

SEQ ID NO: 41890 - DNA, 466 bp, Homo sapiens
atttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtct

SEQ ID NO: 41891 - DNA, 264 bp, Homo sapiens
aactaaccgacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgc

SEQ ID NO: 41892 - DNA, 383 bp, Homo sapiens
aggatgctttgtgcatagctgatgcttagtaatgggctcttattcatctagaaatttttttgcctttaacttcaacctggaaggcttttaaaaaacatgattggccgggcgcggtggctcagcctgtggttccagtgctttgggaggctgaggtgagaggatcacatgtggccaggagtttaagaccagcccgggcaacatagctagaccccgcctcttcaaaaatagggatgaaaaatttagccaggcatggtggtacatgcttgtggctccaggtactcaggagactgaggtgggaggagtgtttgagcccaggtgtttgtggttgcagtgagctatatcgcgccactgaactccagcctgggcaacgggatgagaccctg

SEQ ID NO: 41893 - DNA, 468 bp, Homo sapiens
gagggccaggagcatcgaaggatattggggaggagatttccggcccccatccccgcagcgaccttataaggtctcttcccatgattctctctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgct

SEQ ID NO: 41894 - DNA, 464 bp, Homo sapiens
ctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagttccttagtaaaggacttatcaaactggtttcaaagcacagagctcaagtaatttacaccagaaataccaagggtggagatgctccagctgctggtgaagatgcatgaataggtccaacca

SEQ ID NO: 41895 - DNA, 157 bp, Homo sapiens
tcagcagagtaaggaagcctgagttggacagcacccttacctgaagttgggtagtcttcccaccacctaaaagtgggtagcccaaagtgtggctgagcctggggcttttatatgctcagaatgggagtgtatgtgctaattggtttgtgagtatgcg

SEQ ID NO: 41896 - DNA, 343 bp, Homo sapiens
  misc_feature 17: n = A,T,C or G
aagcgcagacgaggtcntgaatcatgtgacggtggcttgaggaggaacctgtctttaaagctgtccctgaagtgacagcggagaggaccaggcagcccagaaaccccaggcgtggagattgatcctgcgagagaagggggttcatcactggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggacttt

SEQ ID NO: 41897 - DNA, 470 bp, Homo sapiens
agctgtgcttttattttacttagatttgtgggaaatatatgctaataatgttccagcctgaaaaaataacaggtatcaagatactcaagtccttaagctgaccttgttagaaatcctgggaaaggaaagctgactgttccaaagctgtcagtggggtgccagacattcactgtttgaacttaaaaacttggtgcatgttggctgggcacagtggctcacgcttgtaatcccagcactttgggaggccgaggcaggtggatcacaagttcagtggttctagaccagcctgaccaacacagtgaaaccccgtctctactaaaaatacaaaaattagctgggtgtggtggcgggtgcctgtaaccccagctactcgggaggctgaggcaagagaatcgcttgaacccgggaggcagaggttgcagtgagccgagatcgtgcccctgcactccagcttgggcaacagagctaga

SEQ ID NO: 41898 - DNA, 327 bp, Homo sapiens
  misc_feature 14: n = A,T,C or G
gaacatgtgtaacnacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatac

SEQ ID NO: 41899 - DNA, 475 bp, Homo sapiens
  misc_feature 61, 448: n = A,T,C or G
gaggggcggttggctttgttgggtgagcttgtttgtgtccctgtgggtggacgtggctggngattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcanaggctcatctttgcaggcaagcagcct

SEQ ID NO: 41900 - DNA, 487 bp, Homo sapiens
tgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccatcactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaacccttaggagggggttagagagtctgttttgattgatgttttctgaggccctagaggagtttgtatcaatttgtgagtattaatgtcaagtactaccagcactt

SEQ ID NO: 41901 - DNA, 427 bp, Homo sapiens
gttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatttgttcgactggctcctgattacgatgctttggatgttgccaacaaaattgggatcatctaaactgagtccagctgcctaattctgaatatatatatatat

SEQ ID NO: 41902 - DNA, 234 bp, Homo sapiens
agaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcag

SEQ ID NO: 41903 - DNA, 177 bp, Homo sapiens
  misc_feature 33: n = A,T,C or G
gaagaagaaaaaaaattctccgcccctttcctngatctcgctccccccttcggttctttcgaccggtcccccctcccttttttgttctgttttgttttgttttgctacgagtccacattcctgtttgtaatccttggttcgcccggttttctgttttcagtaaagtctcgttacgcc

SEQ ID NO: 41904 - DNA, 498 bp, Homo sapiens
  misc_feature 2, 3, 28, 29: n = A,T,C or G
tnntaattataaaatgggaaatacactnnagttcatctgttcatctgggaaatctggaattaactgtcaaagtaatctaattaattgaatctatttcaaaataacactttaggtatgaatatttctttatatctgctttatcataatcctaaaatgtggcaacatacagacattaaaattatttcagcactgtaagactacattataaatgttagtctatattaacattttgtaactgaaacgtttaaaatttcctaagtgtcacattgtctttactcaaaggaaagcatctcctagctctaacttttatttgctggaaacaaattcagtttctaaggtgatatagcagaaccgtttatcatgtatatattttgatattcaactagattcagtgtttagccataaccaaatatactttaaattttacttcaggaagtttgaaaaatacttatttttcttgataccttacttctcctttttctttctctttttcatatt

SEQ ID NO: 41905 - DNA, 477 bp, Homo sapiens
attgatagttgacatttaaccctgactggcaaataagatccaatcaaaatgtcatggagtaaagggtgtttaaattctttagctgttcatcccaaaatttcctttagaaattaaccacctgccatagggaagatgcgtagatgattaggttagaagttagattgcaactctttgcagctcgttctgctaaccctattcaccaattagcctcactcttcaactgcctccgctaaagatactgaactgaaacttgctccctatggcagctacatggagaagctatggttttgacaggtagcatatgacaatggctattccactattgaaaacctgggcctctggcttaggtgcccccaatctcacctccccactagtacacatatacatgtagttgaaagtcaacaattacagttgttttcaatggagtatagaaataagagagaattggctgggcacggtggctcacacctgtacttt

SEQ ID NO: 41906 - DNA, 477 bp, Homo sapiens
  misc_feature 7, 18, 32: n = A,T,C or G
gagatgnaaagatttatnatcctcatgttatnaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagat

SEQ ID NO: 41907 - DNA, 165 bp, Homo sapiens
atacacacaaatacctgtggctggtaaaaatgatggtgtaaattatatttacagactgataaacgtaaaaagtatctgggacatagccttattgaaaagaaagcaggctagtgaatactataattattttgtaaaagtctcttatggacataagttatatattta

SEQ ID NO: 41908 - DNA, 466 bp, Homo sapiens
catattcgggttttcagaccactcaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcagcttcgaaaggcgatgttggaaaaagacggataatttgcctagtgggattgggccttggtggtcttcttcttcagttttctactttcaatatttcgttccaagtaccacggctatccttatagc

SEQ ID NO: 41909 - DNA, 168 bp, Homo sapiens
  misc_feature 21, 167: n = A,T,C or G
gtataaaaacattaaattgtnagtatttttgtaaggttccattttgtaaagagaataatattcaaagacttttgtagcatacaaagtgaaaacttgtatctgcgaaactatacttgtattaaatgtgctttttaaataaaagctcgtaacacaactaaaaaaaaaang

SEQ ID NO: 41910 - DNA, 100 bp, Homo sapiens
aagcagatgatgattttacctgtcaataccagcactgtattactaacatgcaaaatactgcagatttattttgaaaattaaagttaactggtcacaaatg

SEQ ID NO: 41911 - DNA, 467 bp, Homo sapiens
aggaacaggctgaataattctcttcattttgcacaagtccgtactgaacggatgctgttagaccttctacttgaagcaaatatgtaagtattgcatgagagctataaaggaactaagggattagatcagttgttaagagccattaatgggctcatgggtgttattggcaggcttaaggtaaaatagggggaaaaaagggagagagacagtggggaaacagaacttggcacatgtcatggggaatggtagagtactgccagcaacatcttgagaccattacagaagccatttaggtcatggtcatcaatgcctggtccatattgtgcttacgaaggttccgcctcccctacaaatcaagagatttcaggaattaatgctgatcccctttgttttgtgtgggcttccagaagcctttttcttgccatgtagcaagccagtttgatctgcgcttggttctatttcacctt

SEQ ID NO: 41912 - DNA, 488 bp, Homo sapiens
  misc_feature 2, 32: n = A,T,C or G
cncccctcgcgctgccagcagcttccgccttntacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggacgagttggctgtcatcagctctagaaagggtgtggccgttttacattggctgttttcctcacattcctcaagcaggtaagcttaatcatgttctcatattgaagcagaaactgtttactcatttatctatttacttactgggtctcctgggcactaggtactgtaataaagaactggagaaatacagtcagatgggaagtagcccctgctgtc

SEQ ID NO: 41913 - DNA, 470 bp, Homo sapiens
  misc_feature 31: n = A,T,C or G
gaggaagaggggtaggcagtgctcctgtatnaccagcccttaatgagaccctgaggaaaccacatcatggagatcagcccttctctcctgcaaggaactcatcctatgaaagagcaattagtgcctgcaagagctgtctctgggacagctgttcatgtctatatctgcagggtaaccctcatagtcatatgcagtcatatccatagtcatatcgggagtcagattccagttcgactgagtgagtggagaaactaaacatttattactgaataataacattaataaaccatcttaatgatagtaataataaacatattgatgagtattaacaggaatgatgatgattattatgatactaatatccataattaacaattttaatattgataataatacaaccctgtggacttgggacctaaacagcagtttccccttacaattatcccatatttggccacagggggtaatgt

SEQ ID NO: 41914 - DNA, 431 bp, Homo sapiens
attggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattc

SEQ ID NO: 41915 - DNA, 465 bp, Homo sapiens
gcaatctaaagattgcgtgttatttctaacaaactaacaatgacattcttcacagaactagaaaaaactattttaaaattcttatgaaaccaaaaaagagcccgaatagccaaggcaattctaagcaaaaataacaaagctggaagtatcgcattagccaacttcgaactatactgcaaggctacagtaagcaaaacacagcatggtactgatacaacacctgtaatccctgcacttttggaggccgaggcaggtggatcacctgaggtcagctgttccagatcagcctggccaacatggtgaaaccccatctctactaaaaatacaaaagttagccaggcttggtgacacacgcctgtaatcccacctactcaggagaccaaggcaggagaattgcttgaacctgagagatgggaggttgcagtgagccaagatcacgtcattgcactccagcctgggcaacag

SEQ ID NO: 41916 - DNA, 463 bp, Homo sapiens
gagccaagatggaggagtacgcgcgagtatccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccct

SEQ ID NO: 41917 - DNA, 324 bp, Homo sapiens
  misc_feature 18: n = A,T,C or G
cagaataaaggaacaagnaacgacctagcatagaaatgcctttgtttggccgggcacggtggatcatgcctgtaattccaacaatgtcggaggcagctgtgggcggatcatctgaggtcgggagtttgagaccagcatgaccaagatggacaaactctgtctttactaaaaatacaaaactagccaggcatggtgctgcatgcctgtaatcccggctacttgggaggctgaggcaggagaatcgctagaacccaggaggcggaggttgctgtgagccgagatcgcgccattgcactccaggctgggcaacaagagcaaaactgc

SEQ ID NO: 41918 - DNA, 256 bp, Homo sapiens
  misc_feature 32: n = A,T,C or G
cacacaggtttgaggatgctggggaggggggnagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 41919 - DNA, 274 bp, Homo sapiens
aaaatcctaggatcatttcagaccgcattcaacacagatactcatgtagccccgacgtttcttgtgaagggaattgatgtattgcttgagggggtcgatctctggttctaaggtgttttgtttgtttccatcgtgactaccagaaaattatagaaggccagacgcagtggctcatgcctgtaatcccagcactttgggaggccgaggcaggaggattgcttgagctcaggagttcaagaccagcctgggtgacatggcaaaatcttgtctctac

SEQ ID NO: 41920 - DNA, 462 bp, Homo sapiens
  misc_feature 7: n = A,T,C or G
caacgcntgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtg

SEQ ID NO: 41921 - DNA, 465 bp, Homo sapiens
  misc_feature 4: n = A,T,C or G
aaanttatgtccttaggttaaaaagatcctggatcatgccagatattaaaatatggataaaattggcatgatcttggaatctgaacagaaaagaagctgcttttagctgttttcaactgtttttagcttttctgtctaaacagctgtttattctgtttcacaaactctcttagcagaatatttaggcaaaaaagaagaaaaagaaattgcagaataataggtctaatataatcccagttctaatcacacataaagaaatctgaatggtttacaaaaccattgagagcggtgatataagggctgtgactatagaggaatctcattttctaaattttgtttttctccaatgtatgagaactgggattacagtatacctattattctgcaaaatgaatcattagtttttatttattactcttgcgattaaaactagtaaacattaaatttgagagatgaccaggcact

SEQ ID NO: 41922 - DNA, 198 bp, Homo sapiens
agctaaatattgagtacatatggacacacaggaacaatggacgttgtgtcctacctgagggtggagtgtgggaagaggaacaggattgaaaaactacctattggtactattattacctgggtgatagaacaatctatataccaaacttacgtgacacacggtttacctatataacctgcatatgtacccctgaaccca

SEQ ID NO: 41923 - DNA, 218 bp, Homo sapiens
  misc_feature 15: n = A,T,C or G
atttcagctcatagnacacttattgcatcaagcactatgttgatgctggagaaacaacataaacaaggcagagtgattgtttgcaatagaccatggtaagcacagtgatggacacaaatccatcctggctgctcattctcctgcaggctttggctaccctaaggaaaataacagcttccaaagtgttagtattaaacatccaaatctgccaaagtgtt

SEQ ID NO: 41924 - DNA, 351 bp, Homo sapiens
aattgactgtattctatatgccacacaaaacagtatgggtgtttatgacattcttttctggatatgtttctgatgtttgcatattgaacacagaactgtccacatagagaacttgatttctgcctcttcctggctttgcttttactcatttagtccctagtatgtgaaaggctatgcttaggctccaaggacccaaggatgaataaaatacctccagtaagcttcaggaccattactctagaggtttgtggaacttaaaaagctaaaatgtgttctgttgaatgacaaaaagcattaagttaatagaaaacagagggcttataagtgaatggataaatgaataagtaaaat

SEQ ID NO: 41925 - DNA, 248 bp, Homo sapiens
  misc_feature 7: n = A,T,C or G
gaaaccntcagcctactcattcaaccaatagccctggccgtacgcctaaccgctaacattactgcaggccgcctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacgac

SEQ ID NO: 41926 - DNA, 424 bp, Homo sapiens
  misc_feature 246, 291: n = A,T,C or G
agtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaggttgggcgttgtggctcatgcctgtaatcccagcactttgggaggctgaggcgggtggatcactaggtcaggagttcaagaccagcctggccaacatggngaaaccctgtctgtactaaaaatacaaaaattagctgagcatggnggcgtgtgcctgtaatctcagctactcaggaggctgaggcaggagaatcgcttgaacccaggaggcggaggctgcagtgagctgagattgtgccactgcactccagcctgggagacagagcaagactcagtct

SEQ ID NO: 41927 - DNA, 237 bp, Homo sapiens
  misc_feature 7, 20: n = A,T,C or G
gtttatngacaggtcttttnaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttct

SEQ ID NO: 41928 - DNA, 169 bp, Homo sapiens
  misc_feature 7: n = A,T,C or G
aacaatnttaactttaaatgtaaatggactaattgctccaattaaaagacacagactggcaaactggataaagagtcaagacccatcagtgtgctgtattcaggaaacccatctcatgtgcagagacacacataggctcaaaataaaaggatggaggaagatctaccga

SEQ ID NO: 41929 - DNA, 497 bp, Homo sapiens
  misc_feature 8, 11, 24, 161, 162: n = A,T,C or G
agaaaganccnctggtatcctgtngatcttcgcgtctctggcaaggatcttgttccaaatcatctttcatattacctttataatcatgtggctatgtggccggaacaaagtgacaaatggcctacagctgtgagagcaaatggacatctcctcctgaactnngagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgttttaaagaagctttggaaaacaggggtt

SEQ ID NO: 41930 - DNA, 395 bp, Homo sapiens
cgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatg

SEQ ID NO: 41931 - DNA, 436 bp, Homo sapiens
atccaccttctctcatagttactcgtttttcctctctatgatgaaaagtctactgttttttcatcatagagagtacctgtcctaacaggcgtaaggtgacatctcatagtggttttgatttgtgttttcctgatgaccagtgatgttgagcagcttttcatgtaccttttggctatttttatgtctttggagaaatttcttttcaagtcccttgacatttcttaattgggtcatatatattttttttatcatgttgtatgagttctttatataccttggatattaatcccttatctgatgtatactttgcaaatatttttcccaacatgtaggttgccatttcatttggaaacagcttaagtgtccatcaatagatgaatggataaagaagctgtgggacacacacacacacacacacacacacacacacacacac

SEQ ID NO: 41932 - DNA, 144 bp, Homo sapiens
  misc_feature 8: n = A,T,C or G
atagacantgacttataatgatacaaatgatatcaggatctaaagattatatatatttcttgtgtttatctgatattgatcacaaagtactaagtctacctttgtcttacaaaaaaaatctgtaacataaattttgtaaatgcc

SEQ ID NO: 41933 - DNA, 111 bp, Homo sapiens
cacatggactttggaaaatatttttttcctttgcattcatctctcaaacttagtttttatctttgaccaaccgaacatgaccaaaaaccaaaagtgcattcaaccttacca

SEQ ID NO: 41934 - DNA, 393 bp, Homo sapiens
  misc_feature 61, 71, 108, 392: n = A,T,C or G
agaaggaaaatccctaaaaatgcagcatatagaaagaatacaaaaacagattacaaatganaagctggcanatggttaaagcggaaccagaatgttaaaaaaattagnagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatacagaaaatatgtaggagactgttaaaattggng

SEQ ID NO: 41935 - DNA, 106 bp, Homo sapiens
  misc_feature 18: n = A,T,C or G
gctagtagaacagcaagnagcaattactactcgttctgggcagaccttatccaaagtctggtacaactgtccttagactaatgagcaaaggaggagtcaactaatg

SEQ ID NO: 41936 - DNA, 209 bp, Homo sapiens
  misc_feature 31, 57: n = A,T,C or G
tatgtccaatgtgtttgtgtccttaggcaanttgtgggagtcttgaaatgtcacagnagtaaataacttattactttttgacaagttctttttttctgttggaacactgaattcttctgtgcatatgtacatatgaatacaaatcgaaggcctctacctcctggagttatacaacttggcttgtttacctccacatgctgatgatgact

SEQ ID NO: 41937 - DNA, 259 bp, Homo sapiens
ataagtaagagtgaaaaagtattcttttcttctttaaaaaataagtttttcttgcttatagttaattctagaaaggcaacactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctc

SEQ ID NO: 41938 - DNA, 463 bp, Homo sapiens
  misc_feature 7, 33: n = A,T,C or G
atccggncccaacctgaaaacatcccagccaantaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcactttacactgttcttgtagatggctgctctaaaaagacaaatgaatggggaaagacaatcattgaatacaaaacaaataagccatcacgcctgcccttccttgatattgcacctttggacatcggtggtgctgaccaggaattctt

SEQ ID NO: 41939 - DNA, 410 bp, Homo sapiens
ataagcaattgtcccaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgc

SEQ ID NO: 41940 - DNA, 161 bp, Homo sapiens
  misc_feature 32: n = A,T,C or G
gaacacaaagcctcgaaatcagtgcgctccanctgatctcgttccgccggttccccttggccgccagttccgttctcctcacgggccgaacggaacaaggggtccagcttgcgggggaccctccccagcccattcctgctgtcaaacaaacaaaaccttgc

SEQ ID NO: 41941 - DNA, 310 bp, Homo sapiens
atcaccttgaggttagggttttaacacatgaacagtgacggaacacaacgttcattccatagcaccagggtagtctcctcatgtcaaggtctttacctgaatcacatgcatgatgtaccgttttcatgtaaggttctaggaatctgtggacatctttggggggccattattttgctgatcacatattacatattttttaatattctagactagtatgaaaacaatgccacttccattgctttatatacgtatctatatacacattgtctattgctataattaaaaaaaagttgtagacacaaatatactc

SEQ ID NO: 41942 - DNA, 444 bp, Homo sapiens
  misc_feature 14, 21, 32: n = A,T,C or G
caacaacacatgtnactattnttggacagatntcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagcgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactac

SEQ ID NO: 41943 - DNA, 389 bp, Homo sapiens
  misc_feature 28: n = A,T,C or G
cttactgcaggaaaaggtcccggaatanctgagcagtcaagatgtgtgacttcaccgaagaccagaccgcagagttcaaggaggccttccagctgtttgaccgaacaggtgatggcaagatcctgtacagccagtgtgggggtgtgatgagggccctgggccagaaccctaccaacgccgaggtactcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactg

SEQ ID NO: 41944 - DNA, 433 bp, Homo sapiens
  misc_feature 3, 28: n = A,T,C or G
tgngtgaagattctttccgctttaaaantaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccgggg

SEQ ID NO: 41945 - DNA, 472 bp, Homo sapiens
  misc_feature 8: n = A,T,C or G
agtcaagnaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcataccgtaaaaatggaccacagtgacttatttgtagttgttagttgccctgctacctagtttgttagtgcatttgagcacacattttaattttcctctaattaaaatgtgcagtattttcag

SEQ ID NO: 41946 - DNA, 446 bp, Homo sapiens
  misc_feature 9, 33: n = A,T,C or G
gtttccagnatgaaagctctgtgcaggctcttnttgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattggtaccgaccctgagctaaaatacccaaaaggagctgggagagttgccgttctctaatcaacagagttacatagctgctatcagtgcccgctttgttcagctgcagcatggagagatagataaacgggtggaagttaagccatatgtcttggatgatcagctgtgtgatga

SEQ ID NO: 41947 - DNA, 154 bp, Homo sapiens
  misc_feature 22, 153: n = A,T,C or G
attcaacatttgttcaaaaagnaccaaatgagcatatgtgaagctatttttttttgtcccctggttgatccagtgatttcacctcactattgttattctgatcctcttggatctggtttttaaaaacgtatgttgaaatagttaaaacatacnc

SEQ ID NO: 41948 - DNA, 456 bp, Homo sapiens
  misc_feature 7: n = A,T,C or G
cttgccntttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctacctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctccttcacctttcagtgcagtttcttttcacattaggctgttggttcaaacttttggga

SEQ ID NO: 41949 - DNA, 301 bp, Homo sapiens
  misc_feature 29, 30: n = A,T,C or G
tgccgtggttcatgcttgtaatcccagtnntttgggaggccaaggcaggaggatcccttaagctcagaagttcaagaacagcctgcacaagatggtgagaccctatctctacaaaaaaatttttttttaattagctgggcatgctgctgcgtgcctgtagtcccagctgcttgagaggctgaggtgggaggatcacttgagcccaggagtttgaggctgcagagtgctgtgattgcaccatgcagagtgcctttacgccatggcactccagcctgggcaacagaacaagatctcatctctt

SEQ ID NO: 41950 - DNA, 454 bp, Homo sapiens
  misc_feature 2, 16, 31, 203, 228, 316, 331, 396, 401: n = A,T,C or G
antggaagaacgtaanttctagaagaacttnagatattcaaggtatttaaagcaaaaaatacagaccaaatttatgcgttacaactacaagtgagatgtaaataggaaagatactatgtccatttttttttccctaacaggtatgttgtggattcagagctaatataagtgaagaattatctcaaattctaatgcatctgttngattgttacagacgtttcaactganagatcaatatttacccagcatggaaagaatctcagtgaataaactgtgactataaagaaataacatttatactacatataattttcanagccagtattacagncacatcttgtaaatgtactatcaatactgacaaaaaaaaatacattttcatattgggaacattgnggcangataagcatactgctttttactaaggggcattaattatacaaataatttacct

SEQ ID NO: 41951 - DNA, 416 bp, Homo sapiens
  misc_feature 21, 415: n = A,T,C or G
tgttcagtgtcagccgccagnatatgccaggagtagggagctgcctgacttgcctgaagtggagtggtagaacttcagaagtaactattgtggctataagagaacgtgaatttattgagggacagagtctgggagatgagatttttggaaaaaccagacttaggactaaggggagtcaactatcagagaattgcatggaaatgtcagtacgaaatgaatcagagtaattgaatatcacattttgttcccaaagggggagattcaagaagctggattgtgaagtaacagtaaaggttctctggttgtaaggaatgataaaaacagtacaacaatacacattttttttctttttgagacggtctcttgctcatgtactccagcctgggtgacagagtgagactccatctcaaaaaant

SEQ ID NO: 41952 - DNA, 188 bp, Homo sapiens
  misc_feature 11: n = A,T,C or G
gactttaaatnacaacagtaaaaaaaaaggaaaaagatggtcattatatgataaaaagattattcaacaagatgtaacaatcttaaatatgtatgcatgcaactctagagcacaagattcataaaacaactgctggtagacttcagaaaagaaatggacagcaatgcaataatagaattcaatcactg

SEQ ID NO: 41953 - DNA, 393 bp, Homo sapiens
ctatttcctacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcttttg

SEQ ID NO: 41954 - DNA, 329 bp, Homo sapiens
  misc_feature 1, 21, 254, 283, 299: n = A,T,C or G
naaccctcaaattaaaactanaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgncatatgcttgctatttaaagctgtgtgtnggttttgtttttctgncacattcactagttttttaataaatatttt

SEQ ID NO: 41955 - DNA, 461 bp, Homo sapiens
gcttttcgatccgccatctgcggtggagccgtcaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcgcaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattg

SEQ ID NO: 41956 - DNA, 462 bp, Homo sapiens
  misc_feature 2, 5, 9, 32: n = A,T,C or G
gngcncagnatggttcagcacacataaatctntatggtatattgtattaacagaataaaagataaaaatcacatgattatctcaatagatgtagaagaagcatttaacacaattcagcatcctttcatgataaaagttatcaaattagaaatagtaggaaagtacctcagcataataaagacattatatgaaaagtcaacagctaacatcatactcactggggaaaacaaaagcttttcctttatgatcaggaaaaaggcaaggatacctgcttttgtcacttttattcaacatagtactggaagtcctagcaagagcatttaggcaagaaaaagaaataaaagacatccaaataggaaaggaaaataatattgtccctgtttgcagatgacatgatcctatacatagaaaaccctaaagactacataaaaaactgtgagaactggctgggcgtggtggctc

SEQ ID NO: 41957 - DNA, 271 bp, Homo sapiens
  misc_feature 1, 25, 33, 46: n = A,T,C or G
natgattccctggattatgcaaagnaaaaatgnacccaaacatagnacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacctc

SEQ ID NO: 41958 - DNA, 466 bp, Homo sapiens
  misc_feature 7, 33, 34: n = A,T,C or G
gtgaagngagagtagaaggggagaagtagaacnncagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacct

SEQ ID NO: 41959 - DNA, 366 bp, Homo sapiens
  misc_feature 35, 59, 256: n = A,T,C or G
gtattgcaatgtgcctttttcgtacattggattanaagcctcttactgggtttgagttnctctgatacagaacatttgtagcagctaatttatggaatctggcaaataagctttgggaggaaattcttttaaaagtgttttcttgttaaggaataatctcaacaatggtaaatcatcaagaggttgagaagactcttaggtttgccactcagaaaaaacagtctcattttgctcttcataggtcctgtttttgctntggcaccaattttaatagtaggtggagatgcaaaacaacgtgaatgttcatttttttatgaatagtattaaagctactagaggtgggcaggcaggtcccagtaaatgttg

SEQ ID NO: 41960 - DNA, 237 bp, Homo sapiens
  misc_feature 2, 5, 31, 33: n = A,T,C or G
tnaanaactagcaccaaggaatgggtaggantnctagccctggagctggacatctagggttcaaattctgggagctttgtcagatactgaggcattcagaatggtgggtgggaacactagtcctgcagctgtacagccttgattcaaatcctgcttccccctattatagctgtgagatctcggtttccttacccaaagatgggtagactcaatttagtatgactgttctgtgaattc

SEQ ID NO: 41961 - DNA, 258 bp, Homo sapiens
  misc_feature 33: n = A,T,C or G
aaatgagctgcctacaagttagatgtttgaaantcgaggacggctgcagaccaacacatctacgtcacccttctcagggccccaggaatgctgaggaagtagctttgagccatgatctggtcaaaatggccaaactaacagcctaaacaattctgagggtttttaaaaaattgttttattagtaccaaaattctttacctgcatgcacattctggtcccaattgcctttttcccccgactttctgggttttttttttt

SEQ ID NO: 41962 - DNA, 307 bp, Homo sapiens
  misc_feature 7: n = A,T,C or G
atttganagaatgccttttagtttaatgcatatttaaactaaattgatcctgtagtgttcctggagaagctagagcctgattgtaggctactactcatcaattaacttctacagcggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtgga

SEQ ID NO: 41963 - DNA, 292 bp, Homo sapiens
  misc_feature 33, 34: n = A,T,C or G
atttaaaataaagtttacattgtagttattttnnaatctttgcttgataagtattaagaaatattggacttgctgccgtaatttaaagctctgttgattttgtttccgtttggatttttgggggaggggagcactgtgtttatgctggaatatgaagtctgagaccttccggtgttgggaacacacaagagttgttgaaagttgacaagcagactgcgcatgtctctgatgctttgtatcattcttgagcaatcgctcggtccgtggacaataaacagtattatcaaagaga

SEQ ID NO: 41964 - DNA, 475 bp, Homo sapiens
  misc_feature 7, 32: n = A,T,C or G
atccagngctccaatgacgtggagatccgggntgagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcag

SEQ ID NO: 41965 - DNA, 234 bp, Homo sapiens
atgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgaga

SEQ ID NO: 41966 - DNA, 192 bp, Homo sapiens
  misc_feature 9, 32: n = A,T,C or G
gtgctcagnatatcatggtctttatgatatcngttctttggaatttgttgaaatttttctttgttgtctaatatgtaatcagttataatatatttttcatgtatgcatgaaaggaatctgtatctggatacagagctctctctgtagatgttatatcaaacttgttcattgtgccattagattctctatttt

SEQ ID NO: 41967 - DNA, 309 bp, Homo sapiens
  misc_feature 31: n = A,T,C or G
gacatcataggccagatattgtatggttctntttgtatgaaatgtccagaataggcgaatctgtggaaacagaaaataggttactggttgctttgggctaaggataagaatagagattaactgttaacagcatgaggaatcttcttggagttatgaagacattttaaaactggattgtggtgatggttgtacaattcagtaaattattaaaaattattgaactgtatacttaaaacagatgaattgtatatatgtaaattatacctcaataaagttgtttttaaaatggccaaaggacttatgcacttc

SEQ ID NO: 41968 - DNA, 182 bp, Homo sapiens
tattagtcttgggtataaatcttgttcagttatggtgtggtatcgtgacttcttcatcactggcattcgagtgcctgctgtgtggtaggcacagcctgggtgctggggatgtgccagtggaaaaaaaatagacaaaaatacaaaaatacctgcccttatggaacttccgttctaatggcatt

SEQ ID NO: 41969 - DNA, 309 bp, Homo sapiens
cattgtgccaaaatctcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaat

SEQ ID NO: 41970 - DNA, 283 bp, Homo sapiens
gatttctgaaggatgtcaaattgttaaatttccatgtagtctagggtttcttagcctcagcactattgtcatcttggacccgataaatatttgttgtagaggggtgtcctgtgcattgtagaatgcttactagcatctctggcctccacctgctagtaacagttttcccccaacctccagatgtgacaacccgaacatatctctgggtattgccaaatgtcccatggtaggcaaaagtgcccctgcttgagaaccatagttgcagacatttaacagttaaagt

SEQ ID NO: 41971 - DNA, 248 bp, Homo sapiens
  misc_feature 6, 171: n = A,T,C or G
gttganaacagtgcttggcacctggaagtatgtggcagatgttaacgcccttcctcccttgcactgcgccccctgtgcctacctctagcattgtaacgaccacgtagtattgaaatggccagtttacttgtctgccttcctttccaagaccgttggtgcctagaggactangaatcgtgtcctatttaactttgtgttcccaggtcctagctcaggagttggcaaataagaattaaatgtctgctaca

SEQ ID NO: 41972 - DNA, 417 bp, Homo sapiens
  misc_feature 13, 34: n = A,T,C or G
gtggatcaacagnaagttgactgacatccttttntgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaag

SEQ ID NO: 41973 - DNA, 465 bp, Homo sapiens
  misc_feature 6: n = A,T,C or G
gtctgnctccttgggtttagctcctagggatggaattgctgcatcaagactgctttccagagcaatttatatgcttctcagtagaagacaaggtttctcattttcctatattctcatgaacatagatttcctttgaactttgagtggtttcttaataatttcttcaggaaaatggaagcggacaacctagaatacaagggtgaggaagttacatggcctctagactcttaccaatgttttctcattttggtctttggcttctagcacctgatgctttttgctagatagccctaatagttttctttttccctgtggtattttagattatggatgattttatttgttggtttatttggtcattcatctattcatcattaatcacaggataagtgcctactttgcactaaggccttaccaggttacagggatatagaaatgaaagataagctgcctgccctcaagatc

SEQ ID NO: 41974 - DNA, 461 bp, Homo sapiens
  misc_feature 4, 28, 30: n = A,T,C or G
cgcnctcgggtacctgtaccccacgtantngccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcct

SEQ ID NO: 41975 - DNA, 467 bp, Homo sapiens
  misc_feature 8: n = A,T,C or G
tccacccngttatcacttagccctgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaact

SEQ ID NO: 41976 - DNA, 162 bp, Homo sapiens
gtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgc

SEQ ID NO: 41977 - DNA, 466 bp, Homo sapiens
  misc_feature 132: n = A,T,C or G
attcattcacaaaatatttatgatgtatttactctgcaccaggtcccatgccaagcactggggacacagttatggcaaagtagacaaagcatttgttcatttggagcttagagtccaggaggaatacattangataatgacacaatcaaatataaattgcaagatgtcacaggtgtgacgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctaggtcatcataagact

SEQ ID NO: 41978 - DNA, 337 bp, Homo sapiens
  misc_feature 17: n = A,T,C or G
gctgcctcctttaaagnaagtgtctgacagccttctcacttctagcaaggggcagctgcagaaaatgaaggaatctttagatgacgtgatggattatcttgttaacaacacgcccctcaactggctggtgtttgatttcaccaccatagacttgacatctgagactgatgaaattccagatattatagctttggaagaggagaacggatcaaataattcacatgctaatggccctgtcctctcagggcaagatgttgaataactaacaacaataaaataccccttttggttgaatacgcaatttgtattacattaaacttcctgtttttattcctgt

SEQ ID NO: 41979 - DNA, 437 bp, Homo sapiens
  misc_feature 7: n = A,T,C or G
aagttantttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtgtatttttttac

SEQ ID NO: 41980 - DNA, 469 bp, Homo sapiens
acagccccaacctacccagcctggacccaggcctggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttc

SEQ ID NO: 41981 - DNA, 273 bp, Homo sapiens
  misc_feature 34, 125: n = A,T,C or G
agcttaactaattgctaggattaaattaaggaangtaaagctactcagagcagcaggttccacaagcacaaactttacacatttgtacaattttgaaatgcactacaataaacaaattagagcancacatttgaaatacaggcttctttacataaactgagaggttatacaaaactcagtttcacaagggaacaatctatacctttctaaaagttaatatttcaagtctctaataggcagaatattttactctttaaaatcctgcctttctga

SEQ ID NO: 41982 - DNA, 474 bp, Homo sapiens
aacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttct

SEQ ID NO: 41983 - DNA, 195 bp, Homo sapiens
  misc_feature 8: n = A,T,C or G
aatagcancactggaaaggttttcttttttccttttttctttgttttctttgagatagggttttgttctgtcacccaggctggagtgcagtggcccacaatcacagctcactgcaaccttgaacccctgggatcaaacaattctcttgcctcaggcttagagtagttaggactacaggtgcacatcaccatacct

SEQ ID NO: 41984 - DNA, 456 bp, Homo sapiens
  misc_feature 1, 4, 69, 121, 157: n = A,T,C or G
ngtncatccaagtaccatgcataggaggataactttgttcaagtttgccatgaataactgcccaatagnatctccagtatagctttatgttagaccattcttgcttatctatctgtagggnggggcaaaactgagctccttcatacagtgtttttgngttatttcagggcagtagggttgatctgggaaagagatagataagacaggacataccctgggccaagaaagtacacacactgatggatcttaaaagtccatagaagtggctcatgcctgtagtcccagcacctcggcctctgaaagtgctgggactgcaggcttgagccaccacacctggcctgcctttcattttttgagcccctgctttataccaggcactgtactctctgctttatgtatatttgcatttttcaaatgtggatctgcagacctgttttcaagttatatttaagaatg

SEQ ID NO: 41985 - DNA, 461 bp, Homo sapiens
aggctggccatggagaggagtggctacatttaaccgttttttaggccacagaactgatggaagctgatgcctaagtgggcttaggtggggactgaggaagaaggcagtgtcctggaagaaagatggaatgggagttatcattgggatgatgagatgtcaaaggagcaggtgatgattggccaaaaaagtgaagatccagaggagatacctgctttagagagcagcctttgcacccttgtctctcatgcccgcagctctatcaaaggcaggctgaccatgggattctgccaccctggccacagctgattggagtgggaaagtacctgagccgtggccataacgtggtctggagtgaaagcctgcccatgaaggggcagtgccaaatggagctgatgagatgtccttcatggagtttgaaggagaacccaagtgagtggcaatgtttggagctggggagtcag

SEQ ID NO: 41986 - DNA, 120 bp, Homo sapiens
  misc_feature 33: n = A,T,C or G
agttttcagctcaaataagcctacatataatantacatatttaaaagaccacagagcaactctttgtgagagagaggaactaggattactcttctggcttctagaaagtgattctacaac

SEQ ID NO: 41987 - DNA, 301 bp, Homo sapiens
  misc_feature 8, 12, 33, 60: n = A,T,C or G
caccaccnaggnacttaaaggagaagaaggaanttgtggaagaggcagaaaatggaaganacgcccctgctaacgggaatgctaatgaggagaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagac

SEQ ID NO: 41988 - DNA, 471 bp, Homo sapiens
  misc_feature 30: n = A,T,C or G
tactttcttcttccaaggtgggttaatggngtcatgatttaaaataagagtttaacagtagcgtgtataaatttgatatttatacaccataaatgatgtataaatcatttatgggagagtgatatttgattcagggatgttgacatgatacctttgggaaattctcgtagtaaaatagagttagactgtcaacagggaaaattctaagtaatttgtgaagaaactagtagtagtagtctaaagtgaggcaccaggcaaagagagaagaatcagacaaatcctttagagtaatagttctttacccattcagacccacactccatttagagcatttactgtagaagttcttgagagaagatctcatcctgtagccatatatgctcactatatatatagatataaaacatctctaagaatttcagcttctctttgtgctttttgttagctactttaaatagcttaactttcagt

SEQ ID NO: 41989 - DNA, 191 bp, Homo sapiens
gtcgcccaggctggactgcagtggcatgatcttggctcactgcaacctccacctcctgggttcaagcagttctcgtccctcagctattcaagaggtcgagataggagtatcacttgaggccaggaatttaaggttacagtgagctgtccactgctttctagactgggcaacagagcaaaatgctgtctcag

SEQ ID NO: 41990 - DNA, 105 bp, Homo sapiens
gtttgaggggtgagagaaactatcatcagagtaacaggcaacctacagaatgggagaaaatttttgcaatctatccatctgacaaagggctaatacccagaatct

SEQ ID NO: 41991 - DNA, 485 bp, Homo sapiens
  misc_feature 29, 30, 54, 55, 59, 259, 475: n = A,T,C or G
gacatggaagggtttggaggcagagcttnnaacagggttggaaggatttcctgnnttanaagacaaacgttagcatacccagtaaggaaaatgagtgtaggggccaggggaacccgtgaggatcactctcaaatgagattaaaaacaaggaagcagagaatggtcatgagaatgggattcagattgggaacttgtggggatgagagtgaccaggttgaactgggaagtggaaaaaggagtttgagtcactggcacctanaagcctgcccacgattcctaggaaggctggcagacaccctggaaccctggggagctactggcaaactctcctggattgggcctgatttttttggtgggagaggctgccctggggatcaactttccttctgtgtgtggctcaggagttcttctgcagagatggcgctatctttcctcctcctgtgatgtcctgctcccaaaccattttgtactcttnattacaaaag

SEQ ID NO: 41992 - DNA, 379 bp, Homo sapiens
aaggtcattcctaaaaagctggctgagggagaatttaactcttcagatcaaatatatttgttccacccctggctctgcctcctgatcaaagtcaggggtgatttcagagaggtggcccttcactcagtcagatgctgtgcgcctgctctctctccacgggcattaaaaacaaggcactcatgtgaaaccatgtcctcatcatggcagccgacctcggtttatcacagagtcgaggcccacatctttgatcctcctcataaaactgtctgagagagttgcacaaacccacggatgtcttttattgtttttctaatcacttttaatgtgttttcccacagtttttgtaggtgttgatgtctcagcctggctgtgtcagcga

SEQ ID NO: 41993 - DNA, 327 bp, Homo sapiens
  misc_feature 7, 13: n = A,T,C or G
aaggacntcaagnaagtatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacat

SEQ ID NO: 41994 - DNA, 329 bp, Homo sapiens
  misc_feature 4, 29: n = A,T,C or G
agangggtctaaaggtgcgggagtatganttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagcg

SEQ ID NO: 41995 - DNA, 461 bp, Homo sapiens
  misc_feature 32: n = A,T,C or G
gtccggcgtggccattttcgttggtggtgttnagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccacga

SEQ ID NO: 41996 - DNA, 302 bp, Homo sapiens
atataccaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttg

SEQ ID NO: 41997 - DNA, 265 bp, Homo sapiens
attggctcctcctccagcgaggaggtttaagcctcacctccctgctgggccctgatcaagctggtctgtttgtgtatgaatcttgggagtgagtggcccaagctggatctgagcccagcatttatcatctcagcgctgcctcccacagaagaaggaagacataatgaataaatgaaaccccatgactgtatcaacattcatcaacccattactccaaacgtggctgataaaattgggtacctggattaaaaaaaaaaaaggtggg

SEQ ID NO: 41998 - DNA, 133 bp, Homo sapiens
attacagaagtgttaacttttctaacagaaagcatgattttgattgcttacctacatacgtgttcctagtttttatacatgtgtaaacaattttatataatcaatcatttctattaaatgagcacgtttttgt

SEQ ID NO: 41999 - DNA, 425 bp, Homo sapiens
catatgagtaagctcccttctgtcttttcttgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtg

SEQ ID NO: 42000 - DNA, 468 bp, Homo sapiens
  misc_feature 466: n = A,T,C or G
gattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcanac

SEQ ID NO: 42001 - DNA, 240 bp, Homo sapiens
agagcaggtaaccaggatctgcccaaagaaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctatttgg

SEQ ID NO: 42002 - DNA, 341 bp, Homo sapiens
  misc_feature 219, 223, 240, 275, 281, 320: n = A,T,C or G
cgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtnttgnggaggactccttgacanaccttccggctcttttaaaacccccaactggccanaccggnattaccctgcaggagtcacttgtgtgtggcacattgtanccccaaagaatcagcttatag

SEQ ID NO: 42003 - DNA, 279 bp, Homo sapiens
catcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtccccagttgtgggggggaaagatgatggaggggaacagaaactggacttgatgtttgcggtttgaga

SEQ ID NO: 42004 - DNA, 273 bp, Homo sapiens
  misc_feature 5: n = A,T,C or G
aattntgaagtctggagatactgatccagattattaatagaaggagactgatgcccagaaagtatcactgacttgccttagggcacacagctagtggggtccaagctaaaaacaggctccatgtcttctgatttctagtcaacacttgactgatgaggaggaggagggtttttaagtgtggtgaaggtagaagagagagctggggcattcaagtaaagaaaaccaagatgcatagagagacaagtgcaacaagtgtgcagaatgaaacgaaga

SEQ ID NO: 42005 - DNA, 364 bp, Homo sapiens
atgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatataagga

SEQ ID NO: 42006 - DNA, 156 bp, Homo sapiens
  misc_feature 5, 6: n = A,T,C or G
aagannagaagtgtcaacttggacacagttttctaatttgctcctcatttacccaacaatcatttacttcaaaggctgctctgcctagtagactttagataaatctacaaataaaagccagagactgatgggcagctggaactctaagggaatcat

SEQ ID NO: 42007 - DNA, 375 bp, Homo sapiens
  misc_feature 6, 12, 367: n = A,T,C or G
aagganaggaancaaagccaacagggcaggggttttgtaagtggaactctggattgaccggtcagttgctacaatcagaatactgctttcttggaccttgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaaagttttccccttttttaactgttccctttgcccttcaaactgcagatatttttttttttttaaagggggggaccttctccctacttgattaaagattgagnggaatttt

SEQ ID NO: 42008 - DNA, 470 bp, Homo sapiens
  misc_feature 4: n = A,T,C or G
atantaagaaagaaaaatatgatatttcgtgaaatgaaaaatccttaacaaattattagcacatcccatctagcaatgtgtacaaatattatacacaatgaccaagtaggatttatttcggtaatgcaagattaatttaacattacaaaaccaattaacataatacaccatatcagaagaataaaggacaaaaaccacatgactatctccacaccattaaaaaaaaagtatttgacaaaagtccacatccacacacattcatggtaaaaacattcaacaaactaggaaaagaaagcttccccaacgcgataaaggacatctgtgaaaaactcttggttaccatcgtacttaatgggaaaggattgaatgttttcccccctatgatcaggaacaagaccaagaaatccactatctccacttttatttaacattacagttaaagtgttagcccagaaattagacaagaaaac

SEQ ID NO: 42009 - DNA, 339 bp, Homo sapiens
gcaaaagaagagaggcaacgtgtcctagggacgggcatgatgagtgttccagagggagaagcatcgctgaccccgagcgcaggttttgctagcagattgccctgacatcttgttcatttcagataaaatgtgatgggaaacttctcactgatgtgctcaagtacaggcataaccattaacccagtagagttcagaatatctgcccaaatgtacatatcgttcccatgtattttaacctaaatggaatgtatcttcccttccaagctgcctaaagcgctgttttaggttcatttattttattatgttcagaagcatcaaataaaagttaaacgtttttcc

SEQ ID NO: 42010 - DNA, 271 bp, Homo sapiens
attgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatat

SEQ ID NO: 42011 - DNA, 486 bp, Homo sapiens
  misc_feature 10: n = A,T,C or G
cggcaatctnttggcccggggaggtcacctccccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaatacccttgggtgtgtgcaaatacactgtccaggatgagagccactcagagtggggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaaggat

SEQ ID NO: 42012 - DNA, 304 bp, Homo sapiens
  misc_feature 12, 16, 38: n = A,T,C or G
accttcgtgaantacnaagacctgctcaatgttaaganggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagc

SEQ ID NO: 42013 - DNA, 444 bp, Homo sapiens
  misc_feature 16, 26, 47, 48, 52, 53, 72, 98, 102, 120, 180, 182, 239, 373: n = A,T,C or G
taggactgtgcctgantttaccagangtggcttctacccttttagannaacnnctttaagccctcctctaantctctcctaccctgaagtaggttacnagantagttttaacttacctanattcaacctaccttcttgtatcaaaaacccaatcaatttggcaatgaaatattaaatacncnactttttttttgtattttctgactcagtaattctacttgggaaatctctgctaaganagagatcagaaatgtgcaaaatacttctacatgaaaaagatattctttgcaagttttttaaaaaattaaaataaaatttcaggagcaatctaaatatccaagggttaaataaaagtgaatatgggtattagggntattacataaggtattcataaaattgggggttactaagaataaaaatatgctcacattataaagttaaatg

SEQ ID NO: 42014 - DNA, 212 bp, Homo sapiens
caacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcaattatttagtaaataatctcaataaattttgtgctgtggccttca

SEQ ID NO: 42015 - DNA, 115 bp, Homo sapiens
  misc_feature 26: n = A,T,C or G
cctctctttatatcacctcttatgancattgtttccactttaaaagtaaacacttaataaattttttggaagatctctgattttttatgtgttcatttatgaacattaaatacga

SEQ ID NO: 42016 - DNA, 389 bp, Homo sapiens
acactagaaacatatgcaatgtttttattacctacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatg

SEQ ID NO: 42017 - DNA, 472 bp, Homo sapiens
  misc_feature 401, 417, 441: n = A,T,C or G
atctactgagtacaatgtacactattcaggtgatagatacactaaaagaccagacttcaccactttgcaatatatccatgtaacaaaactgcagtgtgcccacaaatctattttttaaattatggtaaagagatgaaacaaagaatcaacacaaaaagacaaaaatatttggagagataacagtagctattccaacacattagttacaattgaaacaagagaattagccacaacaaacttgaaagatcacaagaatatagccaattagcccacatactacttaagaaatattggaaatgtgatggcatatatcacttgaagggaaggaatgtaaatgggatgtgtatgtgtgtgtgtgtgtttgtgtgtgtgtatatcatatgtatatgatatatatatgnaaatgatatatttagntattaaacataaataaagtttggntaatggtctctatataaaacagtgagatttt

SEQ ID NO: 42018 - DNA, 404 bp, Homo sapiens
  misc_feature 2, 17: n = A,T,C or G
ancctcatcttacagangatgtaaacagaagcttagcaagatgatgatacatgtccacgatcaatcagagagtaagtgacagaggacgtgacctgagggctcctcctcgccaaagcttgtgggtgatcaggcggctattgtgctcagtgtttttctcaatgctcttgacctggttgccaccctctcccaaagtgtcgagattatagctgtgcaccgctgcacccagcctaggggacagttttataatcagtcttcttggccttcagaggactctgctggtggctatacccagctagtggcttgttctctctttccacttttattgccctgaaattctaaatattccatcattttggtagaaagaaaaccagaccaaactaaacattctcatgatttcatccacc

SEQ ID NO: 42019 - DNA, 497 bp, Homo sapiens
  misc_feature 9, 10, 26, 30, 34, 36, 42, 54, 79, 449, 460: n = A,T,C or G
aattcggcnntttattggccggggantgantttnantacctnaattcgtgcacntaatactaatgtaacagcagatganaattgataaaacccaaaagagagtcatctaaatttgtagttcctattttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgttttgtaagtgctttgagatctttgaccaacaggtgctattggagtgcaaagtgttactcttacatgtttatttttgagtcatgagataatcaattttaacccaaagtcattggattattnttttttaaagnccataatgttccgagtacctcagggacatttaagagt

SEQ ID NO: 42020 - DNA, 469 bp, Homo sapiens
gaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttacgagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcagcaacaacagcagcaacaacagcagcaacagcagcacagt

SEQ ID NO: 42021 - DNA, 473 bp, Homo sapiens
  misc_feature 435: n = A,T,C or G
cgtctcccttcgtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtacccgaaagcacagtaatcactggtgtcgatattgtcatgaaccatcacctgcaggaaacaagtttcacaaaagaagcctacaagaagtacatcaaagattacatgaaatcaatcaaagggaaactttgaagaacagagaccagaaagagtaaaaccttttatgacaggggctgcagaacaaatcaagcacatccttgctaatttcaaaaactaccagttctttatttgggngaaaacatgaatcccagatggcattggttgctctattg

SEQ ID NO: 42022 - DNA, 142 bp, Homo sapiens
cgtggtaggtgacgcctgtagtcccagctactagggaggctgaggcaggagaattgcttgaaccctgcagatggagaggttgcagtgagccaagatcacaccattgcactccagcctgggtgacagagcgagagcctatctc

SEQ ID NO: 42023 - DNA, 216 bp, Homo sapiens
acaggaagaagagacacaaattcagagaagatcctttgagggtggacttccttccactgggcaaaagctgtaagtgaatcagcaccattcacgggaatctgggtgagaggaaattcagccaaaccaaatgtctcgatttgaattgaaaaggaattctttccgaacatcctaaactgcctctctacctcctccttctttgcctggttaccttcccca

SEQ ID NO: 42024 - DNA, 377 bp, Homo sapiens
  misc_feature 6, 7, 27, 39: n = A,T,C or G
tcggcnntttatggcccggggaaagantgcttgaggccnaagagttcaagaccaacctggccaacacagcgagaccctgtctcaattttttttaattaaaaaaatattaaatggactaagcacgttaattaagaaactgagatggttagagtgattaaaaaaaaaagaccaaatgagcgtaaaagaaatgcaatttaaatgaaaagacacagttttaacatttaaagagctaggtgagatggttcactcttgtaggcccagcttgtcaggatgctgaagtaggaggattacttgaatgtagaaggttgagactgcagtgagccatgattgattgcaccagtgtactccagcccaggctgcagagtgagacccttttt

SEQ ID NO: 42025 - DNA, 436 bp, Homo sapiens
aagtgagataaaatgaataaagtgtctagacaatatcctagcatagtaggtattcaatcctggtgagatcctgtttataaggcccactactttgtcttatcaggcagaataacaaaggaacaatatttaaaaagcaactagctcaaatctgtccccagaaggaaaaacatatcttgtccttggtccttaaaaaatttcctctgtcactgtctagaatcagcacctaagaacacaggcgtttagtgttgactggaataaaatggaatcgggtgctggtgcagggagattgagcagggatgaagagagaaaatcacagagtggaaaggatcaggtttggagagttcaatggggggctgccaggacataagcctaatatgtgtgggacaaggaaacccctctgaaactcataaagtggtattgtaatacccatctatga

SEQ ID NO: 42026 - DNA, 469 bp, Homo sapiens
  misc_feature 10, 360: n = A,T,C or G
aactgagacngagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgttttttattacctggtttaatggagtaatggnactttttattctttcttgatagaaacctgcttacatttaaccaagcttctattatgcctttttctaacacagactttcttcactgtctttcatttaaaaagaaattaat

SEQ ID NO: 42027 - DNA, 154 bp, Homo sapiens
  misc_feature 7, 8: n = A,T,C or G
tggaganngggttttgccgtgatgggcaggctggtctcgaactcctgacctcaggtaatccgcccacctcagcctcccaaagtgctgggattacaggcatgagccctggcacctggcaatatagagtattcttgacatcttgacctgtgcagta

SEQ ID NO: 42028 - DNA, 249 bp, Homo sapiens
  misc_feature 16, 18, 28, 30, 33, 47, 55, 89: n = A,T,C or G
agtgctctttctagangnctcctaagancnacnagagcacctttttnaaagctcntgcttgttcactcactgttagtgtcgtatttttnagctggggttttgagactccccttagagatagagaaacagacccaagaaatgtgctcaattgcaatgggccacatacctagatctccagatgtcatttcccctctcttattttaaggtatgttaaagaattactaaaacaataaaagctcctaaaaaatc

SEQ ID NO: 42029 - DNA, 473 bp, Homo sapiens
gattctgggcactagtgctagtagatattactaccctcctgagggaaatcagaaatgatttaaccccagtggaatacattaattcttaaagcggctcttttcagtagtgtgacttttagaaagtgtctcagtagttaaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttggtttttccttgaacaactttggaaaaatgggatttgacagtacataatcagttctactaaccaaagcttgtatttgggaaatttaccttt

SEQ ID NO: 42030 - DNA, 473 bp, Homo sapiens
atagtagggagaaagaattatagttaagagtttgtgtaagcagttgtgttctcaggcccaaatcttaaattcacaaaaactaacaaaatttcacttcaggctaactgccaagtctttaatatttctcttcagaattcattttgaagttttttcataacccatatatttaatcatttcatttaggttattaatagaattttcttcttatgataacataccttgtaagcatgaatattttaggtgtcaggagtcattttagatgggcaatgtaaaatttaagtaaatgtgaataatcaaaagttaggccaggccgggtgcagtggctcacgcctgtaatcccagccctttgggaagccaaggtgggtagatcactttgaggtcaggagttcgagaccaacctggccaacaaggcaaaaccttttatatatttactaaaaatataaattagccaggcgtggttttttgggcgcctg

SEQ ID NO: 42031 - DNA, 472 bp, Homo sapiens
cttgaaagctctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgtt

SEQ ID NO: 42032 - DNA, 131 bp, Homo sapiens
atatcctgtttattgaattgctcaacttgggaggctgaggcagaagaatcgcttgaacccaagaggcggggttgcagtgagccgagatcatgccattgctctagcctgggtgacagagtgagattccatct

SEQ ID NO: 42033 - DNA, 468 bp, Homo sapiens
  misc_feature 432: n = A,T,C or G
ctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgacttttatcagcgccgtanagaagtccagaaaacacataaacacctgggtagctg

SEQ ID NO: 42034 - DNA, 122 bp, Homo sapiens
cagcggaagtacagctgtgatagatcaagcagcattcacaagctagaagaccttgttcaggaatcaatggaagagaaagaagaacttctgcagtacaaaagcactatagcaaacctaatggg

SEQ ID NO: 42035 - DNA, 183 bp, Homo sapiens
atactttgatatgatccatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaag

SEQ ID NO: 42036 - DNA, 413 bp, Homo sapiens
  misc_feature 263, 377: n = A,T,C or G
tgtggtggctcacgccctataatcccaacacttcaggaggccgaggtgggcggatctgagtccaggagtttgagaccagcctgggcaacatagcaagaccacatctatataaaacattaaaaaggaccaggcacggtggctcacgcctgtaatcccaacactttgggaggccgaggcgggcagatgagttgaggtcaggagttcgagaccagcctggccaacacaatgaaaccccgttctctactacaaatacaaaaacttanctgggcatggtggcgggcgcctgtagtcccagctactcgagaggctgaggcaggagaatggcatgaacccaggaggcggagctttgcagtgagcccgagattgcgccacttgcncttccatcctgggcaacggagcaagactccatctcc

SEQ ID NO: 42037 - DNA, 328 bp, Homo sapiens
  misc_feature 6, 43: n = A,T,C or G
atagantaaaatcctggaacaaaattaacaagctgttctctcntcctagtccaatctcctcaggacagtttgtttttctctctaatcctctttttctcatttgcaaagttagttaagagggcatcaactaaatccaaaatagtatataggtgaagtaacattgtctatctcacaatcttattgtaagaatgaaattattctaataagaatattaataaatagagctaccgtgtattaagtacataccctgtgccagttgtttttgttcatttattttgatactcataacacttcacaagggagtgttaaatgttattctcatttaata

SEQ ID NO: 42038 - DNA, 303 bp, Homo sapiens
gttcttcctaattattctcccagatcccacactgcagctttatctttaggcttatgaaaggtaacccgtggttaccggctctccaagtgattctgttcttctccatttttggcagttaatttgcagaagtaactgacagctgacaccatatgagaacctttgtataaaatattggcatgtaaacagcacagacaccgtaacacactctgtgccctgttttggttgttgacaatgaagcaccattatgtgactcttcatataacccttttttctacggcagcattaaaattgtctttttgctat

SEQ ID NO: 42039 - DNA, 245 bp, Homo sapiens
  misc_feature 245: n = A,T,C or G
aggtggaaaaaagcaatctaaaagttattggccttaaagaggaggtagagaaagatataggggtagaacatttattcaaagagataataacagagaattctcaaacctagaaaaagatagcaatgtccaagtacaagaagattatacaacaccaagcagatttaacccaaagaagaccacctcaaggaatttaataatccagctcccaagaaacaaggataaagaaattatcatgaaaacagcgn

SEQ ID NO: 42040 - DNA, 419 bp, Homo sapiens
tgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataatttttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttat

SEQ ID NO: 42041 - DNA, 234 bp, Homo sapiens
  misc_feature 10, 23: n = A,T,C or G
ctagtaaccncgttctcctgatnaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctctt

SEQ ID NO: 42042 - DNA, 471 bp, Homo sapiens
  misc_feature 391, 418: n = A,T,C or G
aagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttattggtggtcatgtttggcgagctatttccttatctccatgtttgggaggagtcatggtctttgnggtttggcattacttttcctttgctgntgatgtttatccatgcatcgttgagacttcggaacctcaagaacaaactggag

SEQ ID NO: 42043 - DNA, 180 bp, Homo sapiens
atctaaggctatttttgaggtaggtttaatagtaaacttaacctgtagtcccagctactcgggaggctgaggcaggagaattgcttgaaccggaggttgcaggtgagccgagatcgcgccactgcattccagcaggggcgacagagccagactccgtctccaaaaaacaaacaaacaacc

SEQ ID NO: 42044 - DNA, 471 bp, Homo sapiens
gagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgggggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtgggtggaccttagtgatcaggtggcacctactgacat

SEQ ID NO: 42045 - DNA, 394 bp, Homo sapiens
atttcatttcttgtaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggcccgaatgggcagatcacttgaggtcaggagtttgagaccagcctcgccaacatggtgagaccctgtctctactaaaacgat

SEQ ID NO: 42046 - DNA, 473 bp, Homo sapiens
  misc_feature 471: n = A,T,C or G
aatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacattgtgtctctgtaatagggataatattgatattattcctggtgctacatattttaagaatcattctatcttaatgttggccttgaggccaagatttaccacgtttgcccagtgtattgaattggtgggaagaaaggnag

SEQ ID NO: 42047 - DNA, 472 bp, Homo sapiens
  misc_feature 324, 378, 379, 391, 414, 422, 430, 456: n = A,T,C or G
agccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagntggaagatggacgcaccctgtctgactacaacatccagaaagagtccccttggnncccttggtgctncgtctcagagggggggatgcaanatcttcgngaagaccntgactggtaagaccatcaccctcgangtggagcccagtggca

SEQ ID NO: 42048 - DNA, 383 bp, Homo sapiens
  misc_feature 37: n = A,T,C or G
acagacaacttgagacagtttttttaatcttttaatnagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggagagaggaagcgaacataaagcgggtcaagtgtagtgcatcttttg

SEQ ID NO: 42049 - DNA, 471 bp, Homo sapiens
  misc_feature 356: n = A,T,C or G
gattgctgtgggaggggttttcaggctgctagaaaatactttgtgcaggatagagatctgaggatcaaacagaactcttgatgctgaatatttctacctctaagtaaaattacttcatatttaaaatgtcaagttacatacttttattttaacaggaaagactaatatctcttgtatttggacttttaaaacaaagaaagcttaattttttagaaatctatggtgaaaaaatggttattacagcaaagaatatcattaaacaggtaattatgcatttttatttgacatattttggtctggaacctttgtgaagtttattttttatgttatcctagtaataatatatatattagtgnaatagtaatatagctcatttatgtaaaaactgaaaatttagaaaaatgaaagtaaaacatagccttaccagccaaaagattattgctataggaatatttccacgtgtagactgat

SEQ ID NO: 42050 - DNA, 468 bp, Homo sapiens; identical to SEQ ID NO: 39052

SEQ ID NO: 42051 - DNA, 473 bp, Homo sapiens
attattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcatctagagcacttcagattccgttgccaactcgt

SEQ ID NO: 42052 - DNA, 379 bp, Homo sapiens
aggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcttgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaac

SEQ ID NO: 42053 - DNA, 133 bp, Homo sapiens
gtgtaactctaatttctatcaggtgtcatagatttttaaaattagtatttcattacaaatgtctcagcattggttaactaatttttgccaggaccattattgatcaagcaaataaattcaacagccatttggg

SEQ ID NO: 42054 - DNA, 463 bp, Homo sapiens
  misc_feature 36, 309: n = A,T,C or G
gtgtatagtagactttgggaaaagcgattttttttntgtattcattctgaatagttgaaatgtatatttgtacagtcttttagacctattcaagtgatgctcatgatcctgttactgtgtgcccatcatagatttctttttttagtgttgcccttgctgcgtaataaacgctctatctagtttacctagcaaaagctcaaaactgcgctagtatggactttttggacagacttagtttttgcacataaccttgtacaatcttgcaacagaggccagccacgtaagatatatatctggactctcttgatntaagggattttccttgttctgaatatccttgacattacagctgtcaaaaacaaaaactggtatttcagatctgttttctgaaatcttttaagctaaaatcacatgcaagaattgactttgcagctactaattttgacaccttttagatctgtat

SEQ ID NO: 42055 - DNA, 108 bp, Homo sapiens
catcttgagctcttctttattttgactgtgatttatttggagtggaggcattgtttttaagaaaaacatgtcatgtaggttgtctaaaaataaaatgcatttaaactc

SEQ ID NO: 42056 - DNA, 190 bp, Homo sapiens
  misc_feature 3, 4, 15, 72: n = A,T,C or G
ctnnaaacccaggcngaagccgacccaggcctgctgcctgcatctgcattccctccttccagtgttccttanaacagacatttaggtatctcaggtcctttctaagtgtccctttcctatgtatgcatttccttttttgtctttactatgcactttagcttataaagccaattaaaaacgatgattgagc

SEQ ID NO: 42057 - DNA, 157 bp, Homo sapiens
  misc_feature 5, 12: n = A,T,C or G
caatnacatttntggtttcccattgtttccaatgagttctaataaatgggatttactataataatccaagtatgacatagccggtatgctttcatgaacgtttttatgtagattttcctctcatgaacatgagtaaataaatctgtttcctgaatgg

SEQ ID NO: 42058 - DNA, 471 bp, Homo sapiens
  misc_feature 35, 108, 159: n = A,T,C or G
agggaataaatctaacatgctggcttttagaattncttcttatttttctttcaactttattgccatgtaacatctttaagtcaataaatctgacaattagactgtggntaattttcttgccaaatccatatcttgttttctctatccatagtagcattntaaaacaacagaagggaactttaattacagtaggttgggagccattttctccctttggtcatattttcattgaaattcctacattgtttaatattaggacttagtttgaatatcacatcaacaaggttgctcaatagaaatattatggaatcatttttctgtcatgccacagaacttattaactgtatgttcaaaatgcagctcaattctgatcatttttgctactttcaccactagcatcctggtgctaaccaccatcatttattgcccaggttattgaaatggccagcaaacaggtgtttctgattctgc

SEQ ID NO: 42059 - DNA, 160 bp, Homo sapiens
  misc_feature 12, 18, 40, 74: n = A,T,C or G
catgttcctcantaatcnggaagcaccagtgtttgtgaantacttcacctaacctgtactttaaaagccattcntttgaaaagaaaaaaataaaggaactaaatctactacaagttggaattctgttgactactcaatgcttaagatctaagccagcttt

SEQ ID NO: 42060 - DNA, 197 bp, Homo sapiens
  misc_feature 2, 6: n = A,T,C or G
antgangacgtcagggaaacggggttgagggtggtctcggtgcagaagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcca

SEQ ID NO: 42061 - DNA, 499 bp, Homo sapiens
  misc_feature 5, 452, 457: n = A,T,C or G
tatantgattcagaggtattagaagtcaaactttctagaaagtagatagtccaaacgttttcacactgctgataaagacacacccaagattgagtaatttacttaaaaaaagaagtttaatggactcacagtttcacatggctggggaggcctcacaatcatggcagaaggcaaggaaagaacaaagtcacatcttacagggtggcaggcaaagacagaatgagaagcaagcaaacggggtttccccttataaaaccgtcagatctcatgagacttatccatccccatgagaacagtatggaggaaaccaccccccatgattcaagtgtctcccactgggtccctcccacaacaatgggaattatgggagctacaatttaagatgagttttggatgggaacacagccaaccatatcagacggacgtggggtgaggttgggaggtgagaaatntaagngggattaatccatggaggttccatattttaccataagcatgc

SEQ ID NO: 42062 - DNA, 486 bp, Homo sapiens
  misc_feature 7, 228, 472: n = A,T,C or G
acgagantaaattgattttttacttggctttgtttttaaaggttgatgtatttatttttaagttttgtgtactcttgaaaataggcttttatattgtttcaggatgctgggtttttttttgtttaattcacttgaggttagtcttcttgtaaaaaccctggttaacttatttttatggtgctttggattttttaggcttatgtgccttcagaggaagagaaaaatggngaaattctggcaccaccagaaagtctgtgtgggggaaagccaagtggaatagctgaactccagagggagcctttgttggtgaatgaatcactaaatgttgaaaattcaggcttcagaacaaatgaagaaattcatagcgaatcttataacaaaggagagatatccagtggtaggaaaagacaacgcagaagccataagcggtcacagtgttgaagcagatcctaaagaggttgaaggaggaaanaaaggcatatgcct

SEQ ID NO: 42063 - DNA, 499 bp, Homo sapiens
  misc_feature 15, 26, 40, 46, 50: n = A,T,C or G
gacttgttgtcaccntgtgacctcantagagttgtttaanctaaanttcnaaacttaaggaaagaattacaaattcctttctctaaacctactcgaaatgtgaggtttctcaaaacctctgaatgacataagggaatctactattttcccaattcagtttctttactctctctctgtgtatatttacacaagaagatttgtttcattgggtcattatttcaacaattatttatttagcaccctcttcctcaagaaaatttggcaccctaaatggtgccaaaagagacatgtaaatttttatatttataatacaattgaaaacaaccttgaagaagattgcccaggacacaggaagcccccaagaaagtagactcatttgatgtgcctcagatttggaaatggggttaagagagggtttggaaaggatgaaagaatattaactagaaatcaaaaaatgtcatttggcttatcagagtaagaatagtaacaatttagggag

SEQ ID NO: 42064 - DNA, 311 bp, Homo sapiens
  misc_feature 3, 5, 15: n = A,T,C or G
gancnacgctttttnattctgtcccgctgcgtgttttcctcttgatcgggaactcctgcttctccttgcctcgaaatggaccccaactgctcctgcttgcctgttggctcctgtgcctgtgccggctcctgcaaatgcaaagagtgcaaatgcacctcctgcaagaagagccgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacc

SEQ ID NO: 42065 - DNA, 352 bp, Homo sapiens
cttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaagaacgtggcgaaaccccgtatctattatttaaaaaaattgaaaaagc

SEQ ID NO: 42066 - DNA, 269 bp, Homo sapiens
ctgaacaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaaagtgaaataaagtcagatgggaaagcgg

SEQ ID NO: 42067 - DNA, 292 bp, Homo sapiens
  misc_feature 7, 8, 27, 28, 33: n = A,T,C or G
ctcggcnntttattggccggggaaganncggangaggagggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcc

SEQ ID NO: 42068 - DNA, 190 bp, Homo sapiens
  misc_feature 7, 9, 19, 20, 30, 45: n = A,T,C or G
caagaanantaaagaagannctgcagaatngctaaacttttggcnaagagaatgaaggaggctaaggagaagcgccaggaacaaattgcgaagagacgcagactttcctctctgcgagcttctacttctaagtctgaatccagtcagaaataagattttttgagtaacaaataaataagatcagactcgt

SEQ ID NO: 42069 - DNA, 497 bp, Homo sapiens
  misc_feature 2, 31, 36, 462, 465, 466: n = A,T,C or G
cntctgttgtcttttctgtgtttggtcgatnttaanaactggcaaaatttttgcctatctagtattcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagtggggaaactatcacctaaaatcagtttggaaaacaagacctaaaaagggaaggggatggggattgtggggagagagtgggccgaggtgcctttactacatgtgtgatctgaaaaccctgcttggttctgagctgcgtctattgaattggtaaagtaataccaatggctttttatcatttccttcttccctttaagtttcacttgaaattttaaaaatcatgggtatttttattcnggnnggggatcctttcctgtcttcctggggttcca

SEQ ID NO: 42070 - DNA, 492 bp, Homo sapiens
  misc_feature 2, 16: n = A,T,C or G
anggatggtggttttnagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattgggtggtcctgatcaagaatttgggtgtggggaccgttggcccctgtttgctttttataaaccaaactctatctgaaatcccaacaaaaaaaatttaactccatatgtgttccctcttgttctaatcttgtcaaccag

SEQ ID NO: 42071 - DNA, 266 bp, Homo sapiens
catgtaccctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgtt

SEQ ID NO: 42072 - DNA, 500 bp, Homo sapiens
  misc_feature 11, 16, 28, 62, 94, 123, 171: n = A,T,C or G
aatggaacaangttanatgggcaagacnaactctggcctgggagtcccaggttctcctgtgngggcactttcctggcatatgctaaatgatggnaaagtctgggtctcacgtttctgtgtggncctcacctcactcgacttctgctctttctgttcactctgggcttctgngctttcattaatatagttctttagttttccactggtctgtatcccattctgccttggacgcctttacttcctgctgctcactgagaagcctcatcaggaggcctgtcctggagatgagcttggcacaggtcacttgcacatagggtctcggagcagtccgtcttcaaggtccagataacatgagaaatgaagcttctcacatcgttgttggggatgacggactgtagttgatgggttagcgggaatttcaaactgatcacctggggatgagagcaatgggtaactgaagcttttgggctcgggggacaggtcagtgcccacgttgttgt

SEQ ID NO: 42073 - DNA, 334 bp, Homo sapiens
tgggtgtgattcttatgtaggagaaaaaagaggaacataaatgcagaacacaattatgcaaaattaggagcctttaaaatgaaatatgatattgtaggtagtttcttcaaaacaacatactagttttttatacttgtttattcatcactgaaaacaaaacatatggaaaaggcaatttttctcccagccaaccccttttcctcggatattttttcaagaaaaattttacagcagatgttttcaaatagatttctatttatttgtgggctaccattatatcagtaggatttctctagaacctttccatcacttcacctgagttttctttatcaga

SEQ ID NO: 42074 - DNA, 460 bp, Homo sapiens
  misc_feature 6, 7, 308: n = A,T,C or G
gcaganncgagtctgaggcggagggagtaatggcaggacaagcgtttagaaagtttcttccactctttgaccgagtatttggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagnatggtgacattcttggaaagtacgtagactgaaataagtcactattgaaatggcatcaacatgatgctgcccattccactgaagttctgaaatctttcgtcatgtaaataatttccatatttctcttttataataaactaatgataactaat

SEQ ID NO: 42075 - DNA, 471 bp, Homo sapiens
gtttttaaaaaatctcaaagccagaagaacaagctgaaatagcatcttcaaaaaatggagcgtaaaataaacagaagagaaaaagaaaaggagtatgaagggaaacacaacagcctggaagatactgatcaaggaaagaactgcaaatccacactgatgaccctcaacgttggtggatatttatacattactcaaaaacaaacactgaccaagtacccagacactttccttgaaggtatagtaaatggaaaaatcctctgcccgtttgatgctgatggtcattatttcatagacagggatggtctcctcttcaggcatgtcctaaacttcctacgaaatggagaacttctattgcccgaagggtttcgagaaaatcaacttcttgcacaagaagcagaattctttcagctcaagggactggcagaggaagtgaaatccaggtgggagaaagaacagctaacacccagagag

SEQ ID NO: 42076 - DNA, 470 bp, Homo sapiens
  misc_feature 9, 438: n = A,T,C or G
caagtgccnattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctctttttttaactgttccctttgcccttcaaactgcagatatttttttttttaagnggggacttctccctacttgattaaagattgag

SEQ ID NO: 42077 - DNA, 246 bp, Homo sapiens
gtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacat

SEQ ID NO: 42078 - DNA, 497 bp, Homo sapiens
  misc_feature 5, 390: n = A,T,C or G
ctctngccggggactgtggtccttgccttaccagataacctctttctagagtacggctttgcagcttgcaaagaggcattgccaatgcccttttcgactacgcggtgacaggagacgtgaagatgctgctggccgtccagcgccatctcactgctgtgcaggatgagaatggggacaggtaagtcagaacttttgcatgataggttgtcctgggtggggaagaagaagagcatcgtataatgcatactgactagagataaaaataattgttcaaatatattgagtcctctaactggaatgatgaagaaaaataatgtgtgaataagggttaagtagcacaatttgctgctccatcctgctgctgtcatctgttggaatctgtagtagctnggaggactcatttaagagtgaatctctctgggcaagaaaactaagatggtggtaggtaatggtaccttttttgaaaagccttgctttgttttttgaagtatatttgg

SEQ ID NO: 42079 - DNA, 356 bp, Homo sapiens
atcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaatt

SEQ ID NO: 42080 - DNA, 403 bp, Homo sapiens
aaaggagaacctgagaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatgtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcatttgaagttagaaaatcatgtgaatgacataaaaaag

SEQ ID NO: 42081 - DNA, 470 bp, Homo sapiens
  misc_feature 404, 442, 453: n = A,T,C or G
agtttgggctccttaattccaacatcccatgagtatatcaagatgaataaggaccaagggacctgtgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtcagggttttnttagtaagtaatttttaaaatttaaatggttttaaagngatcattaagnggtccctttttacttat

SEQ ID NO: 42082 - DNA, 240 bp, Homo sapiens
  misc_feature 195, 206, 214: n = A,T,C or G
aggagaaatacttttccttgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatanacttttttcanataacatnttctgagtcataaccagcctggcagt

SEQ ID NO: 42083 - DNA, 209 bp, Homo sapiens
aggaggaacaggcaagagcagcttcattctaagcctttccgtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttag

SEQ ID NO: 42084 - DNA, 487 bp, Homo sapiens
gtgggatcaaggaaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggtttgttgtttatgttttcacaattttaagacttttaaaaaacagaatgaagattattattaaatttttttaatttgcttagttgtatgacttctggaaattaatgcttcttaaagaataggcagttttcaatttgatttgactttgacattttgtggttaaaattattctgtactcattctgctagctttgtggcactcagtttgattct

SEQ ID NO: 42085 - DNA, 423 bp, Homo sapiens
agctgggtggatttacaggctgacacatacagtgtgtctcctagatagtatctaaatggaccattacaatgagctgtgattcctgaattcagatgatgctgtttaatatagaagcggagttggcattttcttgttttcttgttcttaacatgagctttctggtttgcaccaaatggaggggttacccagggtgtaggattttcagggctaaaaccaggctagtcctgggcaaaaagggatggttcatcactctttccatggtttttgaaataagttaatgggtgttctttctcaaggaacacactgaactgaaaacagccaaaagctagtaggtaaaaagtcaccaaggcctattaggaaaaaaagtgaaatgtgatctgtttctggttactactgatgacagtagggtcatttttttttgga

SEQ ID NO: 42086 - DNA, 470 bp, Homo sapiens
  misc_feature 468: n = A,T,C or G
gctctctgggatgtgtagctttggaaatctgtctttgttgctctgggagaggggactcctggaatgtgtctgtgaataaagactagccgaaggtgcgaagtgactagacgggagcaaaggaggaaaactagggaatgggagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttggngg

SEQ ID NO: 42087 - DNA, 471 bp, Homo sapiens
ctataccacaaagttagagaataagtggcaagctggtagaaagcattacagcatacaacacaaaatgaagttcaacaaatatctaaaaaataaggaaagcatatgaacagtcaaaagtcgtatgagaagagtaaatcaatacacacatgaaaagataacttttaattacttgcaatggggaaaatgaaaattaaaataatgagataccattttcacttatcagactgtcatcaaatttagtctttaagtacaaagtgttaactactgtgtggagaaacaagtactctctatgttactggtggttgactaaaggtatagcaatttttttttttgagacaggatctcactctgtcaaccaggctggagtgcagtcgtgcaatcacagctcacagcagcctcagcttctgggctcaagcaatccttccacctcaacctctcaagtacctgggactctaggcatgcaccaccaca

SEQ ID NO: 42088 - DNA, 449 bp, Homo sapiens
  misc_feature 30: n = A,T,C or G
acaacctcggtggtggcccttgcgcagacnagacttcgctcgtactcgtgcgcctcgcttcgcttttcctccgcaaccattgtctgacaaacccgatatggctgagatcgagaaattcgataagtcgaaactgaagaagacagagacgcaagagaaaaatccactgccttccaaagaaacgattgaacaggagaagcaagcaggcgaatcgtaatggaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaag

SEQ ID NO: 42089 - DNA, 320 bp, Homo sapiens
aaatcaattgtttatgatatgagttataaatattttaaatttcagaaaatcaatataatatggaccaaatgttctgacattagtgtaagttatttagaagttaataatgaaaacaatttttaaaaattggcatgtgtttggacatttaaaattatacttctcaatagttggatcaaaaaaagaaatcataatggaaatttaaaatactttgaactggatgatagtgaaaatgctacagatcagttttgtaagagacagtcaaatggaatttaaaaggaaatttatagccttctgtggctgtaaaagaaaattagtaagac

SEQ ID NO: 42090 - DNA, 470 bp, Homo sapiens
aaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgagggtggctgtgcttggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccat

SEQ ID NO: 42091 - DNA, 473 bp, Homo sapiens
ggaccccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttattttaatttttcaaaacaatcctttaaggtcaacattgtcatccttattttgctgatgaggaaactaaggttagaaacattt

SEQ ID NO: 42092 - DNA, 466 bp, Homo sapiens
caggttcctctggaggatgaagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggct

SEQ ID NO: 42093 - DNA, 118 bp, Homo sapiens
  misc_feature 3: n = A,T,C or G
acnaggatgccttttacctgaagtcacagtgagaatggttaggtagcatagggaagattctgaaagccctgtcttgaaagatcttcagaatccaaaccaaactaaaaatctgaggagc

SEQ ID NO: 42094 - DNA, 281 bp, Homo sapiens
agcgctgtgcttttcccgtgctaggcaatggatcacttggagtcctttattgctgaatgtgatcggagaactgagctcgccaagaagcggctggcagaaacacaggaggaaatcagtggcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaga

SEQ ID NO: 42095 - DNA, 180 bp, Homo sapiens
  misc_feature 4, 6: n = A,T,C or G
aatnanagaccttttaaaaaaacttaatttgagcgagtaccttttcatttgacacttttcctgtttctaaccttaggaaaccagaatagcgtttggcagacacgacgttttcagtttacctttgacacctgccccactccattttgctttgtgatgtcttcatttaacaataaattatcc

SEQ ID NO: 42096 - DNA, 178 bp, Homo sapiens
  misc_feature 28: n = A,T,C or G
gtaatactgaatgacagtggaataatcntcaacgaatccctaaagtttacatcatttaaggaaatggggaaacaaaattccagataaataacaagactgaatggctagatttaaaatagtggttttagaaaataggatatcacaagttacagtttttcaaatggattttttttaagat

SEQ ID NO: 42097 - DNA, 205 bp, Homo sapiens
caactaaaactttgattttttttcttagtttattcctttgtctgtccatcataatgggattacgtgtggcaatgggaaaagggagaatacaaaatagaggtgtgcacagcaggctgcggggcttagcccaggctaattgactatatccaaattaagtatgccatcacttgcagtgtgacaaatggatttgacttattcagtatac

SEQ ID NO: 42098 - DNA, 394 bp, Homo sapiens
aagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccagattaccaaggaaccaacatttagattagatattttggttttcacttaggaatg

SEQ ID NO: 42099 - DNA, 275 bp, Homo sapiens
atagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcag

SEQ ID NO: 42100 - DNA, 467 bp, Homo sapiens
  misc_feature 396: n = A,T,C or G
gagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaaagcntttgtatacattgatcaagttcgggggaataaaagacagaccacacctaaaactgcctttctgcttctctt

SEQ ID NO: 42101 - DNA, 103 bp, Homo sapiens
agagcttgtgaggcaggctttccaagtaacccaagggacatgaacaaagcaattctattattttttttaaaaaactaagcatgatttcagagccccccccccc

SEQ ID NO: 42102 - DNA, 190 bp, Homo sapiens
attcgatatttgtgaaaatgcagtgctctgcattatttctgtgaagaaagaatgaaagattccttatccagctactgaggcaggtagtcattgctaagaaagaaactgctttgccatgactttctgccaggatacatgcagtgactaaatatatcttctaagatagacaagacttaacagatcgttttgc

SEQ ID NO: 42103 - DNA, 193 bp, Homo sapiens
  misc_feature 7: n = A,T,C or G
gctggcnagatggtgaaaccccatctctactaaaaatacaaaaattagccagatgcagtggtgtgcacctgtaataccggctactcaggaggctgagccaggagaatcgcttgaacccgggcagcaggagttgcagtgagccgaggtcgtgccactgcactccagcctgggtaatagagtgagacttcatctc

SEQ ID NO: 42104 - DNA, 468 bp, Homo sapiens
  misc_feature 2, 3, 14, 74: n = A,T,C or G
cnngcgcgagcagncaggtgttggagcagctcacagggcagacccctgtgttttccaaagctagatacactgtnagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatggggatcatccttcctggcaaataaattcccgtttctatccaaaagagcaat

SEQ ID NO: 42105 - DNA, 489 bp, Homo sapiens
  misc_feature 26, 451, 453: n = A,T,C or G
gttgtctaagttttctaactaattcncttaattccctctttgtggttctgtccacaaccagtctttggatttctggggttaggcccaggcaaaaataagttccctcaaagttactactactattcaatttactcacaatgccctctaaacacgttatggtcaaaaactaattatacaatcataagaagtgaattttgaaaatataactaataataggctaatatttttaatgttttaatacgtactagacatcttatttgtattacgttacttaaccttaaaaggacccatttaatgaaaactcccttttactaagccttaggcaacttacttactatggccttgaacccagattatctctagcccaaaggcaatgatgttgagggagaaaaaagaggactaagagttatgtggctcaaggtctagtttgggttaagaacataagaggttnanggggacaagggtttgggggatcaaagagacctagat

SEQ ID NO: 42106 - DNA, 500 bp, Homo sapiens
  misc_feature 2, 16, 36, 47, 53, 55, 59, 70, 83, 89, 99, 119, 185, 413,497: n = A,T,C or G
cnccgggccggggacngtgttcactgccctggagtncctccccgacnctggancnaccntacccgagagntaccccaactcanggcctnctcactcaantccccctgcctttcccgacngagacccaactctctgcaatggtaagcccagtagactggacctgactacttttgcgcaatgggacnttagttgcattccgaggtcattatttctggatgcctaagtccatttcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttnggaggactaactggacaaatagtggcagcgctttcaacagcctaaatataagaactggcctgaatctgtgtattttttcaaganaag

SEQ ID NO: 42107 - DNA, 154 bp, Homo sapiens
acaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaat

SEQ ID NO: 42108 - DNA, 408 bp, Homo sapiens
  misc_feature 10, 15, 28, 39, 44, 53, 57, 64, 68, 111, 122, 167, 172, 182,247, 250: n = A,T,C or G
cggggggganggagngagttgagagtancggagccggancgccntggcgaccnaacntcgagcnaganttttaggtcttttcgtggtcagtaaattccgggaaattcaacnaggagctttcnagtggaaggaaatgaaaggccagctgaaatggtgaaccaaatacnccccnttgaaggaanccaggcgggtgatgcagcttgcctctgccaggagtctaccaaaatgaagaaatagtgcagaaganagnaggaaagtacttttctggggtcttagataccagaactacgaatataagcccagacttgaaaagagggctccagaaaaaagtagatgcgtatcttgtacaaacagatcctactgatgaaattcccacttaaaaagtcaaaagaaagcataaaaaagcac

SEQ ID NO: 42109 - DNA, 326 bp, Homo sapiens
  misc_feature 8, 56: n = A,T,C or G
atatgtanaatataaatatcttttttacattatatataatggatatatggttgctntatgttttatgtgtgtatagcagtatctatctatactgccttatttcccaggcctatttatatgcgaaactttttttctgtgaaatcttattgtaccaagaggaataagtatatatgcccacaaaaagactgggtcatagcagcttttttcacagtaggaataaactactgattcacatagcaacatagatgaatctcagaaatactgttcatagcaggagaagccaggcacagatgagtatgtataagtgtttatgatgccatttatga

SEQ ID NO: 42110 - DNA, 481 bp, Homo sapiens
  misc_feature 6, 7, 210, 222, 294, 312, 436, 446: n = A,T,C or G
taaaannagtggctacctcaccatgcagtttcaagctctcagaatttgaactctggaggaatcagttattaatcgtaaatctaatggcagcttccacaactgcttatttttataggcatatttttataggcatgtttttctcaaagtatattctatagaccatcagccccataaattgttagaaaaaaaaaaagcagaaaggctcactancatttaaaagtnggaaaatgttacatactctattctcttcttgaacactcaccttgcacacagtcatagtaggatctgggaagncccatagtaaagaaaatngttaaatgtcacattttcacatttatttgactctaggactctatttacattctgtatgacatttttttgcaaaatgctaacatagatcaatgcagcattatcttgctagaatctaagcttctgngaaggtaganactttccatcttgttggtatccaaatccccagtac

SEQ ID NO: 42111 - DNA, 261 bp, Homo sapiens
  misc_feature 6, 10, 35, 73, 78: n = A,T,C or G
aaaganggangatttgaaaaaactttctctttgcnctttcttcttcttcttttttaactgaaagctgaatccnttccntttctttctgcacatctactttgctttaaattgtgggcaaaaagagaaaaagaaaggattgatcagagcattgtgcaatacagtttcattaacttcctttcccccgctcccccaaaaatttgaattttttttttcaacactcttacacctgttatggaaaatgtcaacctttgtaagaaaacc

SEQ ID NO: 42112 - DNA, 496 bp, Homo sapiens
  misc_feature 13, 14, 24, 35, 36, 45, 46, 48, 49, 60, 61, 62, 65, 76, 78,79, 91, 92, 93, 110, 117, 152, 185, 187, 212, 249, 261,414: n = A,T,C or G
actcccggccccnncgggccgggncacgccgcccnncccccctcnntnntcctggtaacnnngangacgccccacncnntctctggggaannncctgtgaaacccttctnaagtacncttttctaaggctgacactgaactgactgaagacnctacccctcttcactgcccttgaaaagactccnantcttgtaaaagactgtctcttttcntccccttacttgatttactagggtacccattgcccantcacaaataaantacttctgtttttgtcttttgtttctttgttatctgtacatttgtgtgtgtgtgtgtgtgtttgtgtgtgtgtgtgaaatgtcacaagttaattctaaaatgtgaaaggcaaaagatagtcaagatactctttataaaggagcaatgggtaangaagacttgccctacagattttattgagctccgtcaattcagaaagtatggcattcctgcatggatagacaagtaggcaaat

SEQ ID NO: 42113 - DNA, 489 bp, Homo sapiens
  misc_feature 17, 33, 56: n = A,T,C or G
actaaagcacagatccntaagcactaaaaaccnaattgtctgtccttcaaacttcnaactgcagttctttttgcctggtaagaagtgaggtgctaattttgtgtgagatgaactttgtaaactactttgggaagtgttctttggaagtaaggttttttctcctttagtcttatgcttccacttttgtctcagattcacaatccattaaaacatggggaaaaaagaaaaggtaaaattgagagacttttgttagaggagctatttggaatgaaccaacatttcagattttccaaaatgtaagttaggaagtctccattgtctctgcattaacaaaatacactgttactatcttaatctcaagagtgtcattacagtgagaatctcatttaaaagcataccagtgaaattaatagcagtgcttatcaaagaacactgaaatctgtgagaatctttctaggagcattcttttcttcttttagttccaagttc

SEQ ID NO: 42114 - DNA, 498 bp, Homo sapiens
  misc_feature 4, 12, 38, 46, 47, 57, 58, 62, 70, 77, 78, 79, 82, 83, 88,94, 113, 114, 115, 233: n = A,T,C or G
cccngggaaccnccggccccctccgggccgggcccacntccccccnntgccgcgtcnncccnctgttttncaaggtnnnccnnttgcnaagctnagttaaaggttcgttgtannnaagaccccctttaactctggactaactccaaacttgacccaagaatctttgtgaaggttttttctacttaaacactttctctttctaaatccgaggtatttcaaggtgtagtatcctntttcaaaggagctatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataacctagaagttagaaagttttaaaaaagttttccacataatggaaagtccttctgataatttgacaaatagctataataggaacactccctat

SEQ ID NO: 42115 - DNA, 260 bp, Homo sapiens
  misc_feature 18, 20, 38, 67, 73, 87, 110, 117, 133, 135, 156, 165, 171,217, 218, 222: n = A,T,C or G
ggaaggaagtggttgctnanttttgtgaagcccttcanttaacctcgatgtgaaatgggttaaaaantctttntccctgttagaaanaggcctgcattctttttttaacnaacctcnttaaaaaaaccaaaancnaacctctggctttttagagantgacctttntacctnaattttaccatttgtttacccaaagcctgtaggtgcttttaagaannactnactttaaaaagcaaaataaaacctttggtttaccattt

SEQ ID NO: 42116 - DNA, 414 bp, Homo sapiens
  misc_feature 11, 26, 27, 65, 69, 103, 114, 127, 145, 149, 178, 185, 205,214, 231, 244, 399: n = A,T,C or G
cgggatctgcngtgacccggaaaccnncttttgacctgtgtaccagacccccaatgacctgcctntctntgcttgtccttgagacctccaggcagcactggantgccccttganccctggaccaccngtactgccaggcctgtantganagtggggcaggcagcgtctggcagaggantgaggangatgaaggaggacccaggangaggaaganccaggaggaagaaagantgatgatgaagantgatgatgacaccgatgatttaagatgagcttgacacttgacccagttgctggaggcggagttggaggaggacgacaataatgagaacgcaggggaagatggggacaatgacttctctcccttctgatgaggagctagcaaaccttctagagganggagaaggacgggga

SEQ ID NO: 42117 - DNA, 498 bp, Homo sapiens
  misc_feature 1, 6, 27, 98: n = A,T,C or G
nggcanttttggccgggatttcacttnttctagtgtccctctgcgtcacctgcactggagtcaccacttgcctgttgggtaagaccaggatgcaccgntgaaataaaaaggggtcagacaatacaagaaaagccagtagaaattgccaaatgtatcagaatacacacaggctttctaaggatatggcccaagaggaaggctctagagcccaccctgaaacaggatttttgacttcacagagaaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctgggagaatcgctagactctaaaaattataaagggttaagacttggacttt

SEQ ID NO: 42118 - DNA, 498 bp, Homo sapiens
  misc_feature 39, 40, 50, 233, 237: n = A,T,C or G
tggcccggggtggcgggtacaagagtctacagtagaacnngatggcaganttagttctgactgatcagaatgcagcttccacttaccctcagtgtcactttgtacacattaacctctatgtgcctcacttttctctttcataagtagagatgataatactacctcataggattgtagtaaagattaaattagtttatatgttgttataaacgtgtttacgtatgttacatggnaggnaaaagattaaattattttctatgttcaaacagaccctgacatctagcatgtgcacaagagaatataattatattttcgttttacaaaagatatttgtggactttttacaaggcaaatggcaaagagctccctaggcagaggccaataaccctgagtaaagagacgaagcatggaagtatgaaagtgtgctgaaggagttcagtgttgctaaaaatttctttaatggaaaagagtgggggaagatgtcctgggaaatagact

SEQ ID NO: 42119 - DNA, 484 bp, Homo sapiens
  misc_feature 2, 28, 31, 34, 55, 58, 59, 64, 67, 79, 99, 111, 147, 169,371, 396: n = A,T,C or G
cntcggcttaggtgtgggaatccagganganacnctagaccctgggaaggtaaangcnnttgangantgtgacctgaanttgcttgcaatcttcctgantcaaattttganctgggatgaaggaagttgcttttttagggatgagcnaaagaaagtggtttctcgagantggaatctactggtgaaagttgctgtgaacattgttaaaaatgccaataaaggatttaggaattacagaaacctggttgataaaagcagtgccagggtgtgaagaagagttgacttcaattttgaaataagttccctggctgggtgttgggtggctcacacctgcaatcccagtactttaggaggccgagacttggtagatnattttgaggtcaaggagttcaagancagccttgccaacatggtgaaaccccacctctaccaaattagccaggtgtggtgcacaccttgtagtcccagctacttgggaagctga

SEQ ID NO: 42120 - DNA, 500 bp, Homo sapiens
  misc_feature 2, 11, 34, 54, 70, 77, 84, 96, 118, 254: n = A,T,C or G
tntagctgctntaacgcaccctagagggttactntttggagcttacttttaccnggtttttcgtgatgtncctgggncctgttntgaaaaagtagngcttacctgaaattcatattancttcggtggcaatattttgtcgtgttaatgttatattggcattaaataccctcctttagccagctttaagaataaaaactaaaaagaaaaaccaaagaagagatgcatttctgatcagaaccaaagttattgctgngggggctacccattgatctttgccttgcgagttagactttgtagggatatactgtggtaaatggaaaccctagtgaggaagactactttagtcaaatgacctgttttctcaattcaggtgatatctttggatgataactttgctagttatatctgaaactatacagttgtaaaatctagaaaacatattggattccttatttttttttattccgaacacttgttaaaaatgagattttatatggga

SEQ ID NO: 42121 - DNA, 500 bp, Homo sapiens
  misc_feature 2, 19, 27, 375: n = A,T,C or G
tntttggccgggggattcncctgagcncccctacagccagaagagttatgaaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagacttggtgttctcaaacccggnttgggtggtcacctttgctccagtcaacgttacaacggaagtaaaatctgtcgaaatgcaccatgaagctttgagtgaagttcttcctggggacaatgtgggcttcaatgtcaagaatgtgtctg

SEQ ID NO: 42122 - DNA, 306 bp, Homo sapiens
gtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtaagtgttttgca

SEQ ID NO: 42123 - DNA, 473 bp, Homo sapiens
  misc_feature 464: n = A,T,C or G
attatatctgttatggtgatctgtgattagtgatcttcgatgttactactgtgattgttttagggcaccacagggcacacccagataaggcagtgaacttaattgataaatactgtgtgtgttgtgactccttcaccagttacccattccctttctctgctcacttcaagtttccctatgccctgagacacaacagtatttaaattaggtcaattaataaccccacagtggcctctgagtattcaagtgaatggaaaagtcacatccctctcattttaaatcaaaacctagacatgattaagtttagtggaggaaggcatgctgaaagctaaaataggcctcttaaggcaaacagtaggccaagttgtgaatgcaaaggaaaagttcttgaagaaaaaatcaaaagtgctacctccactaagcatatgaataagaaagtgaaacagctttattgctgctagggnagaaagttt

SEQ ID NO: 42124 - DNA, 331 bp, Homo sapiens
tccttgacaatcttgataagtttttttatattagttttattttctagaaaacgtcttatgaatttctcccatttgctctagcatgcttatagaaaatgtcagtgtttcttacagctcaaatttgtatagttgttttaaaatgcggtctctttcttcttcccctggtacttttttctttctgtctactgaagttagttcttatacatggtcttatattttggctgtctttttttccctaggaacattcatacaggttgagtgttccttgtctgaagtgcttgggactggaagtgtttttgattttgggagtttggaatactttttttttttt

SEQ ID NO: 42125 - DNA, 193 bp, Homo sapiens
  misc_feature 4: n = A,T,C or G
gttnacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactc

SEQ ID NO: 42126 - DNA, 472 bp, Homo sapiens
atttgtttaaattgtgtgtattgaaggttaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgt

SEQ ID NO: 42127 - DNA, 310 bp, Homo sapiens
  misc_feature 20: n = A,T,C or G
cagtcatggcgcaggaagangaagatgttagagattacaatttgactgaagaacagaaggcgatcaaggccgagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcacttttttggatgaatgggcttttataaagttcc

SEQ ID NO: 42128 - DNA, 459 bp, Homo sapiens
  misc_feature 4, 24, 30, 31, 32, 33, 34, 37, 59, 69, 125, 153, 389, 393,406: n = A,T,C or G
tgcnagcttaacttttcgtaccantgtgannnnngcntctgcgggggactagctttcanttgttattantgggagccttttttttctgggaaaaattttaccctgaatttattgactttaacaantaaataaggacttttgtccctgttaatnaaatgcctgttgaggcagggcgcggtggcttcatgccctgtaatcccagcactttgggaggccagggtgggtggatcacgaaggtcaggagatcaagacccatcctggctaacatggtgaaaccccatctctactaaaaatacaaaaaattagcctggcatggtggcacgtgccttgtagtcccagctactcgggaggctgaggcaggagaaatcacttaaaccccgggaggcaanaagnttgcagtgacttnaaaggttgcgccactgcgctctagcttaagtgacagaagtaagaactccatct

SEQ ID NO: 42129 - DNA, 500 bp, Homo sapiens
  misc_feature 8, 25, 40, 50, 56, 58, 59, 67, 70, 75, 83: n = A,T,C or G
ctaccccnggggaactcttcggcantttttggcccgggcntcccttgaanttgagncnncttcagangantcttntgaagtantgaaatctgatttcagaatacattacaatcattctcttgacagaaaatttaatcagaatatttaaagcattgttctacaatgcagcaatttgtcagttttatcagtagattcttcaaataaatatataaattttaaaatttttcaaaaaaatgtttttctctggctgggcacagtggctcatgcctgtgatcccagcactttgggaggccaaggcacgcagatcacttgaggtcaggagttcaagaccagcctggccaacatggtgaaacctcttctctactaaaaatacaaaaattagccgggcatggtgctgcatgcctgtaatcccagctactcaagaggctgagaggcgagagaattgcttgaaaccaggaggcgggaggttgcagtgagccaagattgcggccccctgcact

SEQ ID NO: 42130 - DNA, 498 bp, Homo sapiens
  misc_feature 6, 37: n = A,T,C or G
tctganttgtgctgtgatcaggtgtctttttagtatnaatgatttactctcctttgggtagatacccagtagtgggattgctggatcgaatggtttttataattttctatttttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcagaaagcacctattataccaggactttaaaaatcagtctgataagtctttgataagtctaataataataactggataagtccattgaatttgcttctgattactttttctttagtagctaaacatggtatgtactcctatgattacaatgaacactcctctccatttaaattaattattacatttggatgaaatagccaaaatgggtaatgactaaatactg

SEQ ID NO: 42131 - DNA, 115 bp, Homo sapiens
  misc_feature 53, 55, 64, 84: n = A,T,C or G
ctttacctctggccctttttcagactactctgctggtcacctgggttaagacnanctcctgccnttgactaggaacctgggaanctaagggatgagggacctgagggaaaagctt

SEQ ID NO: 42132 - DNA, 472 bp, Homo sapiens
gtatacttaagtaattatgagggttaaatatttttttaaaaaacttcaggcatgatagtgttgaagatatagggttgttttgtttttgtatttttttaaacctatggtatacctgcttttgggaaatgcccattaagcaaggaacaataaaatatatttgtagagatatttagatttatattgggggtttttggtacttaaatgtttgggggagggatgagataatgctcaagatattagaaaccagaaggtgaatctcagttcagcaaaaagtgaatcttttggagaaaatatgatagcactatgagaagttgttgttttttaaagagatggggtctcactatattgtccaggctgatcttgaattcccgaactcaagcgatcctcctgccttagcatccctagtaatcccaacactttgggaggctgaggcgggaggattgcttgagcctaggcgttcaagaccagcctg

SEQ ID NO: 42133 - DNA, 170 bp, Homo sapiens
  misc_feature 2, 3, 38, 39, 55, 57: n = A,T,C or G
tnnatggcccgggtgttggattgaattgttaaaaaccnntggtcaccctctagananggaagtttgcattaccctttaatttttaatacccttttgtattgcttaaaatttgtatgtattatcgttaaaataagaaaaatcaaataaagctattttcattatgggaaaac

SEQ ID NO: 42134 - DNA, 459 bp, Homo sapiens
  misc_feature 434, 452: n = A,T,C or G
caattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggatttgtagaatgggggggttgactattttctgggatgnctccatctattgatgaangggtctt

SEQ ID NO: 42135 - DNA, 207 bp, Homo sapiens
  misc_feature 44, 57, 119, 155, 187, 199: n = A,T,C or G
agaggagaaaaaaaaaaagagagagagagaaagaaagaaaaganggaaaaaaggcgngacttgattttcaaacgaaactcccacagcaaacaaaacccttttagagaaataagaaaggnggaagaaggaagaaaagagggaagaaaaaaacaggngaaagaaaacccttcaggctttcaattcgagngggagagttganccgaaaga

SEQ ID NO: 42136 - DNA, 470 bp, Homo sapiens
gattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacgacgaggtggacttccaagagtactgtgtcttcctgtcctgcatcgccatgatgtgtaacgaattctttgaaggcttcccagataagcagcccaggaagaaatgaaaactcctctgatgtggggtggggggggcctgccagcttgggggccctccctgtcgccagtgggcactttttttttttccaccctggctccttc

SEQ ID NO: 42137 - DNA, 423 bp, Homo sapiens
  misc_feature 1, 19, 45: n = A,T,C or G
ntggcccgggcagtagacnaggggaccccaataaaattgaagacncagtcagagtgggagtgatcaatccagcaaagtggaatggcaggggatcgtaggcaccaaggtccagagtgtaacagtgacaatgtgtggctgatgtgggatcgaggaagtgattgtttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttacccgttgtgcttgagcttgtatgctgtacagtctcacctgagcaggcagatgtagtcctgagct

SEQ ID NO: 42138 - DNA, 112 bp, Homo sapiens
actgtaacccctactgaactgaagtgaatcttagcctaaggagatttctttactcagacatgttgaagaagctaccctggtttctttcttgctacttactgtattaaaatgg

SEQ ID NO: 42139 - DNA, 330 bp, Homo sapiens
  misc_feature 10, 11, 30, 39, 57, 83, 96, 224, 249, 259, 274, 319: n = A,T,C or G
tctccaaganngactaagtctccaggagcnccaaaaaantcctctgtacccaaggangttaccagtaaaccaggatgaacctntttaaaccccacntgggtccctgccacattcccttctcaaggtggtagactgagtggggtctctctgcccaagatccctgcatagcagtagcttgtcttttccacatgatttgtctgtgaaagaaataattttgagatcgntttatctattttctctacggcttangctttgtganggcaaaacacaaatncctttgctaaaaagaacctattattttggattctcaaagataagncctttgagtgt

SEQ ID NO: 42140 - DNA, 379 bp, Homo sapiens
  misc_feature 284, 352: n = A,T,C or G
gaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagaatgagacagagacttaaggaagagaccctgtgagtctgacaataaaagatttggacagaaacagaaagattggagagagagagagagggagagaatgagtgagagagagactggaagagacaganatcagagggagacacagaaagtgagagtggggagagaggtagtgtaaaaggaagagagagagagaganaccgtaagagacgggagacaaagtggc

SEQ ID NO: 42141 - DNA, 473 bp, Homo sapiens
  misc_feature 12: n = A,T,C or G
agtttttaattnttggatactgcttttcaactaaaatttaaaaatctctcctcccttttcaacatctggtttagcaattccttgagagacaaaacagccctttctctctcatcccatctattaaaatgtacctaggtcctgagacagaaacgaatgatcatgtcagagctgaatacttctattcccgtattctgctagaaataagtcctaatgccctaaaatcaaaatattacagtaggacaatcttcaacagtgcaattgatggaaaattagctttggtttcctgttatatcccatgaagtaatttgttacatcaaaatgtataaaaatattgtaatcagttcaatgtatttattttaaagaacaaaataacatttaagtccttatatcttatcccttcatggctgctaaatattttaattcatagtaaactattttaaacattttctttaaagcattttgaaacaatactt

SEQ ID NO: 42142 - DNA, 473 bp, Homo sapiens
  misc_feature 166, 186, 199, 212, 310: n = A,T,C or G
atgaatttgaaggtagaaactatgtctttcttgccttccactatatctccagtactgagaacagagtattttgcatgtaaatgttgcttgaaaagtattttcaaatgaatctgaagcctatgttatacattatatttttagttattttccatactttcatatgggngtagagtggtaattgtaatncattattactgtnaatgatgctttgnaatatataggccctcaagtgccacttgacaatcctttcatacattgcttggtgattctttattacattgttcctggcgaatcagattctttatacagngttttctttctcagtaaatggcactgtcagtgttcaggccagtgttctaggcatcatccttgtcacttactcctctctcatctctagtatccagccatcatgaaggcctgtagaccttacttgctgacatctctggaattccttctctccatgtcactactac

SEQ ID NO: 42143 - DNA, 470 bp, Homo sapiens
atggtgggtttttagggtggttaatcgtctgcgtctagggaaatggccacagcttgcctctccttcggggtgaaaggtaggttctgagtctgtgatttttccctgctcagagtgaataaatattgtaagtaggtgtggtcagctgtccagccctttactttttcagttgggaaggaaagagttgcacagctatgatgttcagagccaacaaggacttgcagacgccctgtgcataggagcagctgaacacattcagaatcatgtaattgagcaggctgctaagtaatggagaaaagaatatcatgcacagagatttgatgtctttttatgggagaacaaaagagtttcgattctttcacattgagtttagcctagccattgtgtggcacaggaggtttaatgaatcatttgtttaactaggatcctgccaagtatttgaccattaaatagactccaatgtgtataagaag

SEQ ID NO: 42144 - DNA, 233 bp, Homo sapiens
  misc_feature 3, 8, 11, 165, 218, 231: n = A,T,C or G
aangaaanatnacagcctttgtacccaatgacggttgcttgaactttattgaggaaaatgatgaagttctggttgctggatttggtcgcaaaggtcatgctgttggtgatattcctggagtccgctttaaggtgtcaaagtagccaatgtttctcttttggcctntacaaaggcagaaggaagaccagatcttaattttaatggggaaaccctggagnaataaatttcatntg

SEQ ID NO: 42145 - DNA, 474 bp, Homo sapiens
  misc_feature 55, 350, 352, 355: n = A,T,C or G
gataccctgagccatctcttcttgtgctacgcctagttattctgtcccccaaatnaaaaggcatgacctttataagaggcgctttactgacaatagctgcaattttaactttgaaaatgattcagaattatcaaagatagtagattcgaatgacatgattgtctataatctcgctagccttgtactgtgtgtgcatagcaattacagggaagtaatctagctcctgactattatgttgaactatgtcgctgctttttacaaacttgtcttgatccaaagcagtcacaatgataaccctgcatatctgggaatcataagtcaactatgtatccctgtgtgtgatatatatngnatngggatggatcctattttcaaactgtgatttaatattttaaaatattcctactgccattttttgtgactgaaaaactacacatgaggaaacgtcttagaattttccaatagaggaaaaat

SEQ ID NO: 42146 - DNA, 255 bp, Homo sapiens
atagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaga

SEQ ID NO: 42147 - DNA, 220 bp, Homo sapiens
  misc_feature 219, 220: n = A,T,C or G
catatcaatggggagttcaggcaataaattatggcatatattgtctactgtatactgtgctggcaccaggggttcagataggaaaacatttcgactgctttttacccttttagtgagtgactaatggacatttctttgtctgaggatatatcttggcagtacaggatttcttcagacgtggctcaggaaatggccgagagtaaggtgagtcacaaggcnn

SEQ ID NO: 42148 - DNA, 315 bp, Homo sapiens
  misc_feature 12: n = A,T,C or G
caatgatatctnagatatgaaagaggcggtaaaatccagtgtcacatgaattatatagcagccaagagataggctggcattctaaccacaaacagaaggaagagcaatacctaggacccaaaggtctataaaagtatgggcaggaaataatgaaatgaaatttggcctggataatataagctaataaacggaaaaaaaaatccaaaacatggatatgcagagagtgtgcaaaaagtggcaaagaaagagggtaataaaagatggcaaactacaaagggagtttcagcagttttagtgtgattgtatctccatatt

SEQ ID NO: 42149 - DNA, 266 bp, Homo sapiens
  misc_feature 11, 17, 77, 104: n = A,T,C or G
tggcccggganacctcntaccttttaagtctgcaagaaaaacctcttacaattgcaccttacaaggatgtttgaaantagaacccttagtggtaacttgaatanaatctagtgacactgagttctggggcttttattgcagtaataattatgatttcctctaaatatttcaagtagttttggaagatttaccttgtacattatataagtggtttatttagctgttttttcatctgacttattgggccagctgatgaaatgtttgtg

SEQ ID NO: 42150 - DNA, 377 bp, Homo sapiens
aaatagcgatgaaaaaggggatgtttcaactgataccacagaaattccaaggatcattaatggctactatgggcaactatatgccaatacactggaaaatctagaagaaatgcataaattcctacacatataaaacctaccaagattgaaccataaagaaattcaaaacctgaagagatcaatgataagcaatgagattgaagccataataaaaagtctttaagcaaagaaaaccccaggacccaatggtttcactgctgaattctactaaacgtttaaagaataactaataccaatcctactcaaactattccaaaaaatagaggaggagggaatatttccaaacacattctacaaggtagtattaccctgataac

SEQ ID NO: 42151 - DNA, 309 bp, Homo sapiens
accgatgctgtgtcttatacaaatactctttctgcgtggtgctgggagtgaccccagatatagccaaagaagggagattgctctccaattgtcaccatgaacaggatctttcagtttcccacagaggatggagtagcgcatgtgttaatcacagggcagtgaaggtcttgaattcagatatgccagcatgtggccaaaggcctgtggccagtcctctgctctctgccagtggctaggcacaaagggctgaggcctctatttatttctgatgagatgtgctgagggagaaatgactggaggcatggagag

SEQ ID NO: 42152 - DNA, 201 bp, Homo sapiens
atcaccctatagaagaactaatgttagtataagtaacatgaaaacattctcctccgcataagcctgcgtcagattaaaacactgaactgacaattaacagcccaatatctacaatcaaccgacaagtcattattaccctcactgtcaacccaacacaggcatgctcataaggaaaggttaaaaaaagtaaaaggaactcgg

SEQ ID NO: 42153 - DNA, 471 bp, Homo sapiens
  misc_feature 284: n = A,T,C or G
gataagcattttaagaatttattttataaagaaaaggtttgatggagcaaagatttaagcattgagaaacccatagacctacaagaaaaaaacatgaatcttatataatcacagaatggggaagaccacttctaagtataatacacattcggatactataaatttttttgaatataaaaacttttttttcccagaaataaatctgcatctttatagccaactgattttctacaaaggcgctaagactatacactggggaaaggataccctcttcaataaatggngctgggaaaattgacgatccatacacagaagattgaaactggacccctgtctctcaccatatacaaaaatcaaccgaagatggattaaagatgtgaatataagaccccaaactttaaaactactagaagaaaacacagggaaaacacttcaagatattggtctaggcaaatattttatgggttaaga

SEQ ID NO: 42154 - DNA, 406 bp, Homo sapiens
agtttattcctttaacaacaatattttatatgtgtcaaaagtctcacttgggagtagtgttttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctga

SEQ ID NO: 42155 - DNA, 306 bp, Homo sapiens
gagaaatataactttaagaaatgggtattgagacccggaaaggattgagacttagctcttcttaaagtctgttggatttactatatttcattagatatatccatgctttcccccacaatcagagggagattattaagcatggaaatagaaaaattagctaactgaagtttttgttggtatgtaagcatgtctgcaaataagatcttaatgtcagcagcataaacatgtatttttaaattgtcttttaaatagaattctgcattaaaaaaaatctagcctgggcaatgtggcaagaccccatctctg

SEQ ID NO: 42156 - DNA, 381 bp, Homo sapiens
  misc_feature 4, 12, 159: n = A,T,C or G
agcnaacacagnagcccaccaagggccttccagtaccatccatccagaagcatgtgataagacctccttccatactggccatattttggaacactgacctagacatgtccagatgggagtcccattcctagcagacaagctgagcaccgttgtaaccangagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcaga

SEQ ID NO: 42157 - DNA, 326 bp, Homo sapiens
agagtgtgtgctttttcagctttaccagatattggtaaattgctgtctgaagcaaatgtagcagttcacactgctgtctagaattttctcatatccttattagattttgaattgtcagaccctgcgatttttactcttatgatggctgtgatatgctttttgttttaatttgtacttcctttattatttatggggataaatatatttccatgtttaataagcatttggatttgttcttctgtcaacaacatatataaatctttgtcaccaaatcagcttttttgaggtatgacttacatgtaataaaatgtgccaattttgattac

SEQ ID NO: 42158 - DNA, 131 bp, Homo sapiens
atctaggaagaggaaaggaaaggcactagcctttcgaaatgaaaggtgtgatcagagagctgggaggactgatggatatccagtggggatatcagcaatttgaaagctgagaagtttgcatttatctgacc

SEQ ID NO: 42159 - DNA, 267 bp, Homo sapiens
cacgacgtatccttgtaccgacttctcccggttcttgtttgaaaatactgtagttcagggtcttgatctagatggcagataggaactttcttgtcacaaaaatactggaggaaaatgttgtaaaaatagacttttggacacacagctgttggggctgcactgagctgcaatttttaacatggatttataacttaatgtttctgtttataaaatactaatgatttgcaatgtattttactggccaattaaaacagatgttttattctt

SEQ ID NO: 42160 - DNA, 473 bp, Homo sapiens
gttcaatgttgatggatatatttggtcatggacaaagaaccgcatgtggagaaaaaatcgttccaagaaccaaaactccaaatgcatcggcactgacctcaacaggaattttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggccaaagttgcaaagattggcactgatgttctatcaactcgatatgaaacccgctacatctatggcccaatagaatcaacaatttacccgatatcaggttcttctttagactgggcttatgacctgggcatcaaacacacat

SEQ ID NO: 42161 - DNA, 243 bp, Homo sapiens
  misc_feature 116: n = A,T,C or G
catcagtacattcaatgatttctcgaaaagttactatagctggatttgatctgaacagctatagggactgtttgacaaagtggaatcgtgctatagagaccatgtataaccagtgnttggaggttggttataaaaagtgcatgttggttcactatgaacaacttgtcttacatcctgaacggtggatgagaacactcttaaagttcctccagattccatggaaccactcagtattgcaccatg

SEQ ID NO: 42162 - DNA, 476 bp, Homo sapiens
aagattgagaatgggaaggttggattctacagctgtctccattaccacaaacaggcactgagacactccctggggaagaaagcaccatttgtccacttgacattggcttctgtcttagccctgtgcatgtcctctaggccttgagtagtgttggctgtgtggtgctgcacctgtgcccaaggccttcttgtgaatcagaagaacccttgaggtcacagacaaagtacttcttaaaacagtagacaaaggcccaggttggcagtatgtacctaggggccccacaggataatttccaggccatgttgaattccaaactcacctaaaaagtgtgacttagaagactttcctgtaaatgaatcctgtgccacccctcccctagaaagctaaagccattgagcttacatatgcaattatgcatgctgctttggcatctgctgcatgttcattatgatagtattcctcagctgggcgcggtg

SEQ ID NO: 42163 - DNA, 349 bp, Homo sapiens
aggaaagaaaagagagtggacttgtcatgtggctctatatttgactctggcttattttatcaatgccataaaggcatagaagacttatcatatttacagacagcacaaggctggtagggataacaagtaaaggataaatcccatataggctgaatattgtgtcaaaactaacttaattgtgatgaaagtaaagccttatatctaggttcatttggtataggactaggtctcttacatgtgattgagctaagggttttagttgtctgcactttaaccaagtcatgtgatgtagcagccaaagaatgctttgcttgcaggagctaggaaaaagaggatttaaaatatatat

SEQ ID NO: 42164 - DNA, 171 bp, Homo sapiens
  misc_feature 23: n = A,T,C or G
aaaaaaggcagcagctaccaagnaaaccagcccctgaaaagaagcctgcagagaagaaacctactacagaggagaagaagcctgctgcataaactcttaaatttgattattccataaaggtcaaatcattttggacagcttcttttgaataaagacctgattatacagaca

SEQ ID NO: 42165 - DNA, 146 bp, Homo sapiens
  misc_feature 19: n = A,T,C or G
agatttcgacagtgtctanggaagaaataaataatagaaggtgctaattggatgatctgagactgtctctctgaggatgtcatgtttaagttgattggtggtaccaaggtgtgtatgggagtttctttagctttcccaatctatcg

SEQ ID NO: 42166 - DNA, 243 bp, Homo sapiens
atcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtct

SEQ ID NO: 42167 - DNA, 490 bp, Homo sapiens
  misc_feature 5, 17, 19: n = A,T,C or G
aaatnataatgtgattntncaaaaacagaactaaagacaaaaaaaacccacatgattatctcaatagatgcaaaaaaaaaggctttcaataaaattcaacagcccttcatgttaacaactctaaataaactaggtatagtagaaacatacctcaaaataataagagccatctatgacaaatccacagtcaatgttatactgaataggcaaaagctagcagtattccccttgaataccagctcaagacaagtatgctgtctgtcaccacttttgttcaacacagtattggatgtcctaaccagagcaaacaggcaagagaaaggaataaagggcttccaaataggaagagtggaagtcaaactatttctgtttgcagacaacatgattatatatctagaaaacctcatagtctcagcccaaaagctcctcccactgataaacaacttcagcaaagttagaggatacaaagtcaatgcacaaaactcactta

SEQ ID NO: 42168 - DNA, 346 bp, Homo sapiens
  misc_feature 8: n = A,T,C or G
cggccttnctggccggggaagcctttggattttatattagtgcgatagaagctttcagagcatttgagatagggaagtattgttacctgataaatatttgagatttttaaacacagtcttttgcatgtgatttataatttggcataaatagaagtttaaatcagtggcagtcagttaaggctgggcaagttcctctctaaatggaggtgtgttacaaaggaaaatcagtaatagtctgtaagtactcaaaactatctcagcaaggtctaggagttggggaggtagaaagacagaggtaaaaccaatctttttggtgggggaggtggggattggaagggttaaggtc

SEQ ID NO: 42169 - DNA, 289 bp, Homo sapiens
tgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcctcctgtgttgtac

SEQ ID NO: 42170 - DNA, 471 bp, Homo sapiens
aggcaggagtaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatatgccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatagaaagaaatggaagaacattccatgctcatgggtaggaggaatcaatatcgtgaaaatggccatactgcccaaggtaatttacagattcaatgccatccccatcaagctaccaatgccttt

SEQ ID NO: 42171 - DNA, 450 bp, Homo sapiens
  misc_feature 440: n = A,T,C or G
acgttcaagcagaaacaaaaagagagctaaaagtgaaagccaccccgccaccagccctcaccagtcacaggtggaattaaagaaatctggcaaaaaataaattttgttatccgtgcttggggcggtgacccttgaccccattcctatttaaacatctggattctctgccataacatcttttgccacctatagctacaataaagtgtcgtcttggagtctgttgtacatttaagaataaacttttgtaaggaagtaaaaaagagtctacagttcagtgcaggatagggatgggtgggccttaattcaggaggtgggaggctcaaaatcaattactctgttgaggagatggaatctcctggaatctcaaaaaggatttcctttaggaatcatcagactcatccgactcgtcaagtctttctctgcttggagttttgttttgnttttgttttg

SEQ ID NO: 42172 - DNA, 485 bp, Homo sapiens
tggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgct

SEQ ID NO: 42173 - DNA, 473 bp, Homo sapiens
gtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtg

SEQ ID NO: 42174 - DNA, 269 bp, Homo sapiens
aaggttatgaatgtcaagggaggcctgataaactgtttcagattgaggaagaagagacatgacaactaaaggcagcttgtgatcctgaactagatcattttgctatcaaaaacatgatgggtacatttgccaaaacttgagtggttgtaatgtactgatgcgaatttactgattttgatgtttatattttagttatgtaggagaatgttcttatttgtaagaaaatacactacaaagaaagatgggacatcaagacaacaaattactct

SEQ ID NO: 42175 - DNA, 134 bp, Homo sapiens
acattttccaaataatatctttaacttgtacatttgaaaagtgttcagagtggccctcctaccatccttccttccactccagccaactcttcctgctaaactgtattccagtttccaagtttactaattgactt

SEQ ID NO: 42176 - DNA, 233 bp, Homo sapiens
  misc_feature 170: n = A,T,C or G
atgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaanagttctataagctgtgtatacagttttttatgtaaaatattaaaagactatgatgatgacatt

SEQ ID NO: 42177 - DNA, 363 bp, Homo sapiens
  misc_feature 303, 319, 336, 361, 363: n = A,T,C or G
aggcgactgggggctgaagagcgcgccgccctctcgtcccactttccggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccanaaggatttggtgggcntccaggaaatgccttcnaattaatgaaccggctgaatcctgngn

SEQ ID NO: 42178 - DNA, 239 bp, Homo sapiens
  misc_feature 237: n = A,T,C or G
agggcatgattaacaaagtcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcntt

SEQ ID NO: 42179 - DNA, 298 bp, Homo sapiens
catgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatct

SEQ ID NO: 42180 - DNA, 226 bp, Homo sapiens
tcactgggtctggcatgtaatttatggcttacttcctatatgttactttaacataaatacatgatgaaaaaaataagaatgactggcctatttattacctagatggtactaataagaacaatgattggcttatttgaaagttttctgtgtgatgtaatgtgttgtaatgtcccactatagcttgcaaaacagtgttatttttttgtaaaataaaaaacataatttg

SEQ ID NO: 42181 - DNA, 351 bp, Homo sapiens
gagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtctcgatattacttggcttgtatacctttgctctatttgcatgctggccttactctgccactgacaggctgtctgtatggtgtggaagaggacggctagcatccccatacctgcatccatacagtttgc

SEQ ID NO: 42182 - DNA, 465 bp, Homo sapiens
  misc_feature 3: n = A,T,C or G
atnacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattgggatggcttcttttgtcaccctgatctcctatgttaccaatgtgtatcgtctccttctccctaaagtgtacttaatctttgctttctttgcacaatgtctttggttg

SEQ ID NO: 42183 - DNA, 465 bp, Homo sapiens
ctctagtgtcaccaccacagggtcaccagccaccatcataggtgggtacagtgtcattctttcctgacatcttccgctttggagtagaaaacaaagtaagggaggttttaaaagtcccagcctcttggctggatagtttgtggaagaggaggaggaataagaggagaacggagcaagagaagcccaccaattaactggtaaacgcttgcaggtttctctggcccagcccaggctggagaggagattggctttgctgtcgataaacaagtccctggtgcagcatcaaagctgttctgctttatcaatcgtggcccccccttcccgcatgttcctgtaacttaccaagcatttatgacattgattttacaatcgggctgttaaccctcccgccccttcaggcctgccaacctttttggcccaagctatcaatcagatgtcatccagccaatcagaagcatccctaag

SEQ ID NO: 42184 - DNA, 471 bp, Homo sapiens
atctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagactccaggaaaaaatccagcaaacagaggccaccaacaagattcttcaagagaaacttaatgaaatgagctatgaactaaagtgtgctcaggagttgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattc

SEQ ID NO: 42185 - DNA, 310 bp, Homo sapiens
  misc_feature 29, 308: n = A,T,C or G
attggagtgagtaagaaaaggacaccagnatggtaaactaaattcacaagatgaaatgaagaaaaccagaatggtaaataagaagattaatataataaactctttaaatgcttgtagtcctagctacttgggaggctgaggcaggagaatcgcttgaacctgggaggcgggaggttgcagtgagccaagatcatgccactacgctccagcctggaaatcataaggaatagaaaatatatttactattcattaagtggaattgaatcatcataaagggcttcatccctcttagtcttcatttcctggcncc

SEQ ID NO: 42186 - DNA, 470 bp, Homo sapiens
gtaacagggcagtaataaaagctaatatttattgaccacttgctctgtgccaggtatttgttatctcattttatcttcacaatgaccttataagatagctactgtctttatagtatcattctagttttacagatggtaaacctgaggcacaatcaggctaagctagttgcataaggtcacaaagctagcaagaggtaaagctagaatttggcctctatgggctgacccaaatgtagaactctaaccactgtaccacagtgtagttgtccaggcggtaaatcctttgttgactgggtcacaaatgatgcatatagatggtttttacagtgtaaaatctcatgacttaagttattcaaattttgtgtaaagataatcaaaatataaatttcaaaatacactcagaaataggttcatttgtttatgtaaaatatactaaaaagagcttaggacattaagtgcctccatgaatg

SEQ ID NO: 42187 - DNA, 284 bp, Homo sapiens
aattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtatatatatatatatg

SEQ ID NO: 42188 - DNA, 378 bp, Homo sapiens
  misc_feature 376, 377: n = A,T,C or G
aaagaaagtgtggtacatatacaccatggactcctatgcagccataaaaacgacaagatcatgttctttgcagcaacatggatggacctggaggccatcatcctaagcgaattaatgcaagaacagaaaaaccaaatactgcatgttctcccctctaaatgagagctaaacattgagtaaacatggacacaaagaggggaacaatagacacttaggcctacttgagggtggagggtagtaggagggtgaggattgaaaaactacctatcaggtattatgcttatcacctgggtcacaaaataatctgtataccaaactcccatgacacgtaatttacccatgtaacaaacctgcacatgcaccccctgaacctaannt

SEQ ID NO: 42189 - DNA, 330 bp, Homo sapiens
agggtattttaaaattttgtgtttgaaattaaataacagttttccaggcatatgtttaaattactgagatgagtacttttgaggagactactatcttaactgaaaattttaattttaatgtgattttgggttgccgccttaaaatctgcatgttttcaaatttgaaataaaaccaactggagtgagaggtcttgactaattgtgatttaaactttgcaagtagtttgacaaatttcagatcctaaggaaatatttgtaaataagatatatgctttttttaaaaaaaattaggactttagtaaacagtctatttctttgagaaaagaaagc

SEQ ID NO: 42190 - DNA, 468 bp, Homo sapiens
agtgagagggcagaggaaatactcaatctgtgccactcactgccttgagcctgcttcctcactccaggactgccagaggaagcgatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtataca

SEQ ID NO: 42191 - DNA, 471 bp, Homo sapiens
ataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagaattttgact

SEQ ID NO: 42192 - DNA, 182 bp, Homo sapiens
  misc_feature 6: n = A,T,C or G
atcagnaacttgagaatacataagtgtttaagttccagcccatttttgcaggtaacagtttataaaatactctggaataaacagtgaagattattctctgtttcggggtaattatatacagtgtttcacttgattttgttttgttttgtttcagcctgggcaacaaagtgagaacctgtctc

SEQ ID NO: 42193 - DNA, 473 bp, Homo sapiens
gaaatgaaaatattgccttgcctttctgaacaaaagaaagctgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagc

SEQ ID NO: 42194 - DNA, 465 bp, Homo sapiens
atgaaaagaaacaatttttaaatttaacatcactgagggcatcctatccctttcatttcatgattccattatgtcctttcacttagatgaaatgataagatgacgagatgagatgaaatgatgagatgaaatgacaaaatgatgagatgagatgagatgatgagatgaaatggagagtggaaatgatgagatgaaatgatgagatgaaatgacaaagttgaaaataaattgaaaggagatgagatgaaatgagatgaaacgatgagatgatgaaatgatgagatgaaacgagatgaaatgatgaggtgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatg

SEQ ID NO: 42195 - DNA, 468 bp, Homo sapiens
cggtctcagtttcctcatcgtaagatcggataatcatagtacagaccatatagggttggttggattaaataagttataggtaaagcagttagactagtgcctggaaatatgtaagtattatttactatattaataaaaactttaatattattatggaataccttctaataacatgggaaggtttttaacatagggagaaaaagcagaacacaagattatataaatggaattaccgtaactatgtagaaaaatatacaaaagggataaggaaatactacaaatattaaggtttttgggggaggggagaatggatgagattccttgtgatttttgctttcgtctcagagctgttttgtattttctgctgttctacagtaagcatatgttacttctataatttgaaaaagtaaactttgttttcaaaagtggatgtaggctgggcgcagtggctcatgcctgtaatcccag

SEQ ID NO: 42196 - DNA, 398 bp, Homo sapiens
agcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagt

SEQ ID NO: 42197 - DNA, 139 bp, Homo sapiens
gttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgt

SEQ ID NO: 42198 - DNA, 107 bp, Homo sapiens
cgggagtaactatgactctcttaaggtagccaaatgcctcgtcatctaattagtgacgcgcatgaatggatgaacgagattcccactgtccctacctactatccagc

SEQ ID NO: 42199 - DNA, 336 bp, Homo sapiens
gtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 42200 - DNA, 382 bp, Homo sapiens
gacgacagatatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtaga

SEQ ID NO: 42201 - DNA, 469 bp, Homo sapiens
aagacctggattctaaggctgaatttaaggctagtttatctccatccttagatttcctacatttcatttaagagaaaatgtcctgtatattgaatattcatgaaaatctctgaaaggtgttatgcttattcttaacctcttaaaggtgtacactgaatgtaattaaatcgtttttgctggctctggttcctcatgaacatctgcttttgtacttccctgtcattcacaaatgcacttaggagctaatgatctatgaggacttttttttcccctacagtaacgagcagcaaatctggctgcactttaatttctcatctgctgtcccatattgtctggtggtcagttcatgatgttactaagcttggctttattggcatcttttgtgagctgctgctgctttttccttggcctcccaaagtgctgggattacaggtgtgggccatcacacccagccaattttgaagtattt

SEQ ID NO: 42202 - DNA, 468 bp, Homo sapiens
  misc_feature 463: n = A,T,C or G
attgccggtcttctcattgcctggctgctagaggaaacccgaagtcgggattctttctttcctgctctgagagggaccaggtccctcctccgtagcttttgtctctctattgcctgcgccgtgtcctggactgctcacgggagttctgcaggagacgccggaatatctggaagctgaaaaatggaaataaatggaaagaccagaatattgaagatcactacagaaatctaagggtcaggcatggtggctcacacctgtaatcccagcactttgggaagcagaggcagttggatcacttgaacctgggaggcgttctggaggtcaggagttcgagaccagcttggccaacatggtgaaaccctgtgtctgctaaaaatacaaaaattagccgggcctcatggcacatgcctgtaatcccagctactctggaggctgaagcaggagaatcgcttgaacctgggangcgga

SEQ ID NO: 42203 - DNA, 471 bp, Homo sapiens
agagtgttcatgttttagaagacaaattgttgagattttcaattccctccaggctgacctacagattcagtgccatcccaattgacatcatactggacatttttaatgaaactaatatattgattctcaatttatttggacatacaaagaacctagaggagtcaaaacaatttttaactggagaacaaatttagaatacttacactacttgatctcaatattactataaagctagtaatgaagactttgcattattgtaagtatagagacatagatcaatgaaatggaagagagagttcaaaagtagttcacatatataatggtcaattgattttcaataaggtaaatgcaaaaggataatcttttcaagaatggaattagaacaacaggacatctatctgggaagagaggaaactccacccttaactcatagcacatgtgaagattaacacatgatggctcataaatgta

SEQ ID NO: 42204 - DNA, 254 bp, Homo sapiens
gcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagacc

SEQ ID NO: 42205 - DNA, 198 bp, Homo sapiens
cagcctggccaacatggtgagacccccgtctctactaaaaatacaaaaaattagctggtcatggtggtgggcacctgtaatcccacctactcaggaggctgaggcaggagaattgcttgaacctgggaggcggaggttgcagtgagctgagattgcgccactgcgctccagcctgggtgacagtgagagactctgtgt

SEQ ID NO: 42206 - DNA, 430 bp, Homo sapiens
  misc_feature 68: n = A,T,C or G
attaaccttggtttatcactctagattcaacatattaaaatgtattcaagctcacagatttttaatcngtaaggcctatctatattagttgtcttttatttcttctccttgtggacagttgttaatgaaaggagtaaggatttccctttttttgttttgtttgttttgtttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttg

SEQ ID NO: 42207 - DNA, 422 bp, Homo sapiens
  misc_feature 45, 47, 72: n = A,T,C or G
tatggaccgggaaacaatccgaaacttagcaattgggtgggcagntntgtaaaatttgtgtgtgcgattaangtaatacacgtaaaatagattgttataactaaaggatgtactatgtaagcctaaaggtaatcatgaagcaaactcttatagtagatacacaaaaaataaagagaaataaatcaaagcgtaccactatagaaaagcatcagttcacaaaggaagatagcaagaaagaagaaagaatcaaaggatctacaaaacggacagaaaacaattgacaaaagggcaatagtaagtctttacctattcataatttgtttaaaggtaacctgaattaaaatttccaatcaaaatatacacagagtggccaaatggattaaaacaagatgcaactaaatactactgtccaaaaactcact

SEQ ID NO: 42208 - DNA, 471 bp, Homo sapiens
gacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaag

SEQ ID NO: 42209 - DNA, 402 bp, Homo sapiens
agacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccct

SEQ ID NO: 42210 - DNA, 226 bp, Homo sapiens
acgatcaaaaggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccc

SEQ ID NO: 42211 - DNA, 201 bp, Homo sapiens
agatatgggtgatactcaagtgacaattcatcttgaagtaaattctccttcggttatgaacctttgaagttaaacaagttatctacttccaaaaatacaattgtgagacaggaatagaacaagcattcccattccttcagggagaaatagccatccccccaacaaaaaaaaaagaagatgaagaaagagaagaaaaggggg

SEQ ID NO: 42212 - DNA, 345 bp, Homo sapiens
aagaaataatatttttagataatcacttgagccccttaagattatacccaggccaggcacagtggctcacacctgtaatcctagttcttcaggagcctgaaatgggagaagtgcttgaggccaggagtttgagaccagcctggtcaacacagtgaaaccccatctcttttgtttttaaataaattttaattttaaaataagaccaaaaaaagaaaaaaaaggaatatgtaggtctattgaattatgctgttaggttaaaattaacaagttcaatatttatttgtttaatgctatccaacaatagtagatgaaatgcccttaatatttcccttagataccaaaaga

SEQ ID NO: 42213 - DNA, 100 bp, Homo sapiens
aatgcaaattggttccacatttttactggagggtaatcagtttttaaaattcacacacatgtaatcgaaacgcaatactataaagttctactggtgagag

SEQ ID NO: 42214 - DNA, 112 bp, Homo sapiens
  misc_feature 21: n = A,T,C or G
tggctggccgcggttctggangtggtgagcattgaggcccagtaagacactcatgtggctagtgtttgccgaatgaaactcaactcaataaaaaacaaaaaccaaattgggc

SEQ ID NO: 42215 - DNA, 397 bp, Homo sapiens
ctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaac

SEQ ID NO: 42216 - DNA, 311 bp, Homo sapiens
agaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagc

SEQ ID NO: 42217 - DNA, 441 bp, Homo sapiens
gtctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgcctccaccctcgtgctgtcaactgccgcaagaagaagtatggtcacaccaacaacctgcgtcccaagaagaaggtcaaataaggtggttctttccttg

SEQ ID NO: 42218 - DNA, 473 bp, Homo sapiens
agacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttactttgccatctaaggaaagaaaggtgccaatattacacagcaagtttcagcgactacgccaagtactatgcacttgtctgctacggcccaggcatccccatttccacccttcatgatggacgcactgatcaagaaat

SEQ ID NO: 42219 - DNA, 471 bp, Homo sapiens
  misc_feature 105, 255: n = A,T,C or G
atagtctaataggatatgtgtacagagttatggtgtctataagcacaaggcagaaagtgacaagtgacttaatccatgttcaccaagtgttctttgagaattcanaaaaaggaaagagaaaatcaagagagagaaatggaaaagtatttatggaatacttagcctttgagtaagtctttaaaattgtgctaattgagatttggaagtacggaagatagtagagaagtgaagtcatttctcatgaggggagttttngacataacagggaataaaaccactggagtgaagtgtccacgtgagaagtagcaaatattgggaaatgaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcact

SEQ ID NO: 42220 - DNA, 470 bp, Homo sapiens
  misc_feature 22, 31: n = A,T,C or G
aatctaatgatgtacctcaagnaaaccaagnaaaagcaagaacaaaccaaataaaaaattagtagaagggaagaaataataaatatcagagcagaactaaatgaaatggagacaaaaatagagactaaaagagattaacaaaatgaaaactttggttttctgaaaagataaaatagataaacctttagctagaccaagagaaaaacagaaaagacccaaaaaaaattagaacaaaaaggagacattacaattgataccacagaaatagaatcattagagactattaggaacaactaacaacaacagattcctggacacatataatcaaccaagatagaatgaggaagaaatagaaaacctgtgcagaccaataattagcaatgagattgaatcagtaataaaaagcctcccaacaaagaaaagcccaggatcagatggctttaccactgaattctaccaaatttataaat

SEQ ID NO: 42221 - DNA, 469 bp, Homo sapiens
  misc_feature 18: n = A,T,C or G
gttcaaagaaggcaaagnaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcaatacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagcca

SEQ ID NO: 42222 - DNA, 446 bp, Homo sapiens
gaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcattt

SEQ ID NO: 42223 - DNA, 131 bp, Homo sapiens
tccactgacccttaactacaaataatacaaaaagcccatcaatctgttccatgccccataaacaaggactgactgtatttagccttgtattttgtctccctagaaccttatctcagagcccgcctaattcc

SEQ ID NO: 42224 - DNA, 443 bp, Homo sapiens
atacacattccaggaaatactattttagtataagttggttcataatggcagttaaattgctcttgtgttttgccaccttggacaaaagtgcttttgtctttctggttttcttcttttggttttatttaattttgaaccctgggaagaaggatacgatgtaaatttaataaaatgagttttcctccctttttgttttttcctgaatcttcatggaacttttttggaaacgtggaacctaggtggggtgggtgacgagaaaggcctgagaaatgccaggaagacatgaggttggattggcctttgggcatccagtttacctaatgtgtgtatgtcatgtatgttaccgttgaggaagtcagtgctgattatgccaaatttctactttttctggatcattttactccttagcatttgtaggggaagacatttatttgagcagaaga

SEQ ID NO: 42225 - DNA, 110 bp, Homo sapiens
gactgaccattctgtgaaagtagcagaatgtgaggagcacgcgtgagcttatgtaccgtgaagatgatcagaggatatcttattttaagagtaaaaacccacataatttt

SEQ ID NO: 42226 - DNA, 324 bp, Homo sapiens
gattacaggtgtgagccaccatgcctagcaggaagctctttcgaatgacattgacacttaagcagtagctataggtggaagggaacaagaggcataggatgagaatttagtacactatcctgtattctttagtaaataaaattctttgatttgtttatttatagctctctttgtcaagcacacaatcctccattataattctgtggaaaattagtttaccttctatcagggtttctccagcacccccaactggaatctaattcagctaatcactgttaacaggttaaaaataaaggaaagaaaaagtagggaaattatatgtgc

SEQ ID NO: 42227 - DNA, 470 bp, Homo sapiens
atggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggt

SEQ ID NO: 42228 - DNA, 170 bp, Homo sapiens
  misc_feature 6, 14: n = A,T,C or G
gtaccncaccagcnagtcagctttctcctggccagccgcaccagctctgccctcccttctgttaacaccagccagaccccctgtaggtctaacccaaggtttttctgtaggacaccttggcctacctgggaatgctggaaacatgttgttaaaggaatcatggtgttgag

SEQ ID NO: 42229 - DNA, 300 bp, Homo sapiens
agagaggagagaactaagctccctctctcctgggacaaagcttatgctctgctctgaaagtgtccgtcttgagtgagccttaatcagcatcgcgaatatggagtatcttagtttcttttgaatggtaatcgattgtttaggggaatagttttaaatttactaaataatgtgtttttcttttaatgttaaggaatataaaaaaggacccccaaaatgtttcataatctactgcacagataagccttttgccataaaaggtaaaagaaaaacaaagtaaaaacaaaaaactataatgtgcat

SEQ ID NO: 42230 - DNA, 482 bp, Homo sapiens
  misc_feature 18, 178, 260: n = A,T,C or G
ctaataagagttcaaagnagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactngaatcataagaaaatgccatctctttttagttgaaggaaaactctggaagtaggtgccattggtcattctgcagtgcactgnaaccattgtttcccctagtgccctcttttcccttgggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaat

SEQ ID NO: 42231 - DNA, 468 bp, Homo sapiens
  misc_feature 4, 13: n = A,T,C or G
cagncgcgcggtncccggcttccgacgtgcagcctggcagtgcagtgagctgtctggccttttgtccttgatccttggttaaggaaatgaccaaccagtacggtattctcttcaaacaagagcaagcccatgatgatgccatttggtcacgttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtc

SEQ ID NO: 42232 - DNA, 322 bp, Homo sapiens
  misc_feature 25: n = A,T,C or G
agtccatcatagcaaagctagaagnaagatttgctgaaaattcagaaagaacgtgattttcatcgaatgcatcataagcgaatagtccaggaaaaaaacaaattaattaatgacctcaaaggatggtggaaaattggcaaagcaggaccgtgatgcctaagagaagacaaacacaaaatgagcaggatgatcaacccacatatcttcctgaaggtcttagaagattggacattgccaatggaaagatcaatgaacatgaagacaggaagatggaaaatgatccaactggtgcacaaagagaaaaagctgaaaagaaatgagc

SEQ ID NO: 42233 - DNA, 471 bp, Homo sapiens
acataagtattactttaaaaatgtacaaataggaatagagtcatcagtcagtgactaaggatagctgaactcaatttgctgatgtttaaattgtctaatgtcctgtctttcagagagaacaacatttggccttcaaatatctgggattgtgggtgaggtgaaaggaaaggtgaattctaataatgaatcaaggcaggaactgaaggaggctttgtttgtttctttaacttgttttgtaataagatcagttgtttcagtgaataaccaagttgtagtgacatgaagaattgcacgttgcttgtgagatgcagaatgacatagaaactgccaagattcttttcatttatcatgaattccagagaaagaacttttgaccaaaagtatcacattctttgttttaacaaaaaaactgaacagtattaattccttagagaatacagcattccagctttacttgaaatcccaaatgga

SEQ ID NO: 42234 - DNA, 378 bp, Homo sapiens
atgtctttcaaggagttctatgtcttttcgtgaaacaagcctagagtctggggttgcctgtgggagttggtttttgggcagagagtagtgctggccagtcgggtcactcttaagtgtgacagaagtagaaactgtttacttttcactatatgagtttacattttaacatatcatgttgttaccagtttttcaaaaatgtgtgttttattgattcccaaagactgacttctgtattcacatggatattttagatttccttgtatctaatgtcttgtggtaaatattgctgttaaggataaaataataatattttgacattaatctgataggataaaatctttaggataaaaatggtgtgaaatgaatgagattttcttg

SEQ ID NO: 42235 - DNA, 108 bp, Homo sapiens
  misc_feature 6: n = A,T,C or G
cacctncacttgatttctactagatggctttattgtataaggaagatatgttcttaaatactacacctaatccaaaacaagagtaatgcaaaagcgttaaaagatgcg

SEQ ID NO: 42236 - DNA, 452 bp, Homo sapiens
  misc_feature 103, 124, 137, 145, 211, 225, 243, 289, 331, 371: n = A,T,C or G
gtttgctggatccgtttgaccaatttgcaccagttttatccataatgatggatttaacagcatgacaaaaattattttttttttgttcttgatggagattaanatgccttgaattgtctagggngttctgtacttanaaagtaanagctctaagtacctttcctacattttctttttttattaaacagatatcttcagtttaatgcaaganaacattttactgtngtacaatcatgttctggnggtttgattgtttacaggatattccaaaataaaaggactctggaanattttcattgaggataaattgccataatatgatgcaaactgngcttctctatgataattacaatacaaaggttccattcagngcagcatatacaataatgtaatttagtctaacacagttgaccctattttttgacacttccattgtttaaaaatacacatgg

SEQ ID NO: 42237 - DNA, 470 bp, Homo sapiens
aactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggag

SEQ ID NO: 42238 - DNA, 224 bp, Homo sapiens
  misc_feature 25: n = A,T,C or G
attggggaataagcataaccctganattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaat

SEQ ID NO: 42239 - DNA, 384 bp, Homo sapiens
ccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggtaaatggtttactaatgtgatttggggctttgagtttgatttttagaaatggaaacatttcttaggatttttcggtcttaacagtgacagggatcatctataatgtaaatttttagacaagaagtg

SEQ ID NO: 42240 - DNA, 451 bp, Homo sapiens
agcccactgtagtgatagctccatatgtttaaatgtatttatcagaaagtaagaaaaaatgagctaagtattcaatccaagcagaaaacaaacaagaaacagaagcaacccaaaagggacaaacaagaagaaaataaaatagataagaacataaatcaatgaaatagggaagattaacaaaaccaaaagcaatttctttaaaatattaatacaatatacaaaaagctctggcaaatctaatcaatacaataaggggaagatgcaaatttacaaaacagaatccaaaagaggaaataactgcaaaaacaatgtaaaatcttttttataaagacatcaatttgaagacacaggcaacatggacacactgttggaaaagtatgatattccaaattggagcaaggataaatagattttcatttaaaattcataatggtaattaaagcctccccca

SEQ ID NO: 42241 - DNA, 337 bp, Homo sapiens
  misc_feature 211: n = A,T,C or G
aacagtgttcacagcatcttcactaggagtagattctatctcaagaaaccactttcactgagcacagtgactcatgcctgtaatcccagcactttgggaggccgaggcaggaggatcgctggagcccaggagttgaagaccagcttgggcaacatagtgagaccttttctctacaaaaaataaaaaaattaaccaggcatggtgttgcacngactgtattcccagctacttgggaggctgaggtgggagaatggctggagcccaggaggttgaggctgcagaagctgtgatcatgccactgcattccagcctgggtgacagagtaagaccctgtccc

SEQ ID NO: 42242 - DNA, 386 bp, Homo sapiens
tcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatattgtaaggcctttctttct

SEQ ID NO: 42243 - DNA, 109 bp, Homo sapiens
ataacaccaaggtcgtggtttctatcccattacagggcagtcaagctcaagggaaaaaccctgttctttggcacagcttccatggcctgctagccgtttacagcgaggc

SEQ ID NO: 42244 - DNA, 453 bp, Homo sapiens
cacccagggaaactcggccttatggccggatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtataagattttgcaaatattatgctatatgtaatacctaactgtatctgtagtgtatatg

SEQ ID NO: 42245 - DNA, 409 bp, Homo sapiens
accgcggatgactttgagcaggagagtgaagtggtggagtcttatgtttcaggcttagtctggcagcttgttggagaaagggctgaaagagtgtggaaggaggctgggcatggtggctcacacctgtaatcccagcactttgggaggccaaggcgggtcgatcacaaggtcaggagtaggagaccagcctggtcaatacagtgaaacgccatctctactaaaaaatacaaaaattagccagtactaatttttgtatttttttacaaaaaatacataatgatggtggcgggcacctgtaatcccagctacctaggaggctgaggcaggagaattgcttgaacgcgggaggcagaggttacagtgagctgagatcgtgccacacctgggtgacagagcaagactctgtggc

SEQ ID NO: 42246 - DNA, 163 bp, Homo sapiens
  misc_feature 11: n = A,T,C or G
aaaagaaaacngctcctccacagatctccagctttacaatctaagacattacgtggcagcaccatctcctcctggggtctcaagttccaggaccctcagacctgaatcgcagcaccagctcttccccggatctccagcttgacgaccttcagacttaaacaac

SEQ ID NO: 42247 - DNA, 342 bp, Homo sapiens
  misc_feature 18: n = A,T,C or G
cagactggcttatcaagnacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgaga

SEQ ID NO: 42248 - DNA, 439 bp, Homo sapiens
acttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtatttttttaaaat

SEQ ID NO: 42249 - DNA, 379 bp, Homo sapiens
  misc_feature 9, 377: n = A,T,C or G
caccaaggnagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaggatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacngc

SEQ ID NO: 42250 - DNA, 313 bp, Homo sapiens
gatgtttgaaaatattcttactggtgaatagttttagttaatggtgtatgactgaacatctctacccttttcatcaaatataattctttgaactgtatccttttaacaggtctcagtcttaaaatttgagctgtgaaaaagtaggttacttttgcttattaatttttttccttttaggaattatattcaaagaaacatttcaaaattgattttttatataatttgccttttactttttcttgtctttatacttttgaattcaaagagtcatctttaagtaaaatgagctttctccttgtaataatacacagac

SEQ ID NO: 42251 - DNA, 264 bp, Homo sapiens
cagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtt

SEQ ID NO: 42252 - DNA, 354 bp, Homo sapiens
atggcagttgatgctctatggtcactgtcttgaaatttccaatagttgcattcttgcatttgtgttttgcaagtaaagtgggacaattgggcatgcaccaggggcttggactctcctttcccctttcagacagctcccttgttcttgcccagcaaacactgccaccctctattctcaatgggcggctaggcataggcatgaggaaggtcaggtgctcacattccataagccaaattgtagggcaaggtccaatgcctatgagtgtctgctctcaccaaccagtatccttgtgcccaagggagttacatgaaatagcaaatagaaaacactatgacaagtcatgaaagagaccac

SEQ ID NO: 42253 - DNA, 407 bp, Homo sapiens
atgtaggaaggaacttggttgcttcaggtggtgtaggattatatttacctgtatgaaatgcaattttaattatgttgaatagttttttaaaagatgattgagaacagtgatctggaataagatgaacctgaactcagtctgtgcatcttcacatctgatatctgccgtgtgatcttgagaagatggtttactccctttgagttttattattgcaatctataaaaaaggaaatataatacctaactaacacctggttctctgaagattaaatgggactgtgactggtatttagcaagtacatgggctaaacatttttgccaaagtcattagagagaaaaatgtgtgctttctgtatttccaatgatgggcaattcatgaatgtttccagcaagaggagaacttctagg

SEQ ID NO: 42254 - DNA, 186 bp, Homo sapiens
agagaagatccttttaaaaatatctgttaccgtggctggagtgcagtgacgtgatcacggctcactgcagccacagccttccagctcaggcgggagaattgcttgactctgggaggtggaggttgctgtgagccaagatcgcaccattgcactctagcctgggcaataacagcaaaactccgtccc

SEQ ID NO: 42255 - DNA, 333 bp, Homo sapiens
gtggcatttgctgaactccttcagtgcatatgcatgtgagtatgtgtatacagtgtgtttttgactgtctttctttaccagagattttacatctataaagtacctgaaaagctgaacacctaagaagtatttatgatataatagacatctggatgaaatttaaaaattaaattaaaactcccagtagctttgtctgcagatgccacacttctggaaacatctgtgtctttgtgtgtttgggtgtgagttcatggagagtttttcctcctcatttttatgtgattcttaggaattgagtagacataagcttacataacaaaatatttcaactgc

SEQ ID NO: 42256 - DNA, 320 bp, Homo sapiens
aggaataagacaaggatacccacttgcaccacttctatttggcataatactggaagacctagccagagaaatcaggcaaaaaaagaaataaaattgtcatcaaaattgaaaaagaaaaaggtaaagtgtctctttttgcagatgacataatcttacatatagaaaaccctgactccaccaaaataactgttagaactaataaacaaattctgtaaattagcaggatacaaaatcaatatactaaaattagcaacatttccataaactaacgaggaactatctttaaaaaaatcaataaaataatcccattcaccatagcg

SEQ ID NO: 42257 - DNA, 366 bp, Homo sapiens
tcaacatacttatagctgctttcagattgctttattgtctgcagtctttagagggctttttttaagagaaaatgttatgttttctgattcttcatgacgctcttttccctgtctggtttataatgttttattatgagttcattttcagtggatttccattgtccttcaggaatgcagtttgtcctgagatgtggaagttttctgacaaaacgtctctcccagagcctgcctggcaggtctctccctgacctgcctggccaaaatggtgaaaccccatctctactaaaagtacaaaaattatccgggcatggtggtgggtgcctgtaatcccagctacctgggaagctgaggcatgagaaatgcttc

SEQ ID NO: 42258 - DNA, 107 bp, Homo sapiens
  misc_feature 10: n = A,T,C or G
cactgaaatncccctttaatggttgcataatttaacattatatggatgttccatgtaatgttaaatatgtgtaatattccatgtcatttaattgtattttccatgtc

SEQ ID NO: 42259 - DNA, 209 bp, Homo sapiens
  misc_feature 209: n = A,T,C or G
gttcttggaaagacctgactatagttacctcctttggttgaaccaaaggaggtaactgggaaaaaggctgtgtgaaccattcttctcccagcgtagttttgagaaagaaatctcagggcagacaacaagaagggtggcccaaataactgaaggaagtcattcccattattccttttcttttcctttttggacagtgtctcgctttgccn

SEQ ID NO: 42260 - DNA, 281 bp, Homo sapiens
  misc_feature 90: n = A,T,C or G
gttcccatgaatcttctgctcttgtttgtgtgacatggaacaaataacttctttgccaccactttgccttagataactgtgtgtgtgtgngccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgta

SEQ ID NO: 42261 - DNA, 261 bp, Homo sapiens
  misc_feature 63: n = A,T,C or G
gctgctggcctgaatgcttataggtggcctctccttgtggcctgggcctcctcacaacatggngtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatg

SEQ ID NO: 42262 - DNA, 412 bp, Homo sapiens
atcataggccttgctgagaaattggaatgaatgacagtatttgaataacgctttgctcagttctgtagtttcgattcgaaatacagacttaaaaagtcgatgaacattcagacatttctctttaaacaagacttccccttctattctttagagttggaaattattctctgcttgggaatagttttcaatatgttccagacattataaatgacttcccttctatttccatgtatttcccatgttgattacagccaggctgatcagagtaaagcaccaggtgtcatagcatcctaatattatatgaatcatgcatttatccattcatctatgcatgtatccagggaaaacagatttttccccctacttgatcggttctacagattcagattcctgtatatttaggtaacattcc

SEQ ID NO: 42263 - DNA, 380 bp, Homo sapiens
  misc_feature 376, 379: n = A,T,C or G
gcaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagactgacgacaaaaggagcttcatctttcaagataacccgtggaattgaagcagtnggng

SEQ ID NO: 42264 - DNA, 339 bp, Homo sapiens
gtcttcttttgagaagtgtctgttcatatccttcacccactttttgatggggttgtttgtttttttcttgtaaatttgtttgagttcattttagattctggatattagccctttgtcagatgagtaggttgcaaaattttctccctttccgtaggttgcctgttcactctgatggcagtttcttttgctgtgcagaagctgtttagtttaattagatcccatttgtcaattttggcttttgttgccattgcttttggtgttttagacatgcagtccttgcccatgcctatgtcctgaatggtattgcctaggttttcttctagggtttttatggtttta

SEQ ID NO: 42265 - DNA, 367 bp, Homo sapiens
gtgcgatggaaaactaaagttataaattatatcataaccattggacctctttttaaaatgcactgaagccttatagtgttatccatggatatatatctatgataaaaatagaaaaaatatatgatggtggtgcttctgaaagggaggggaacggtactggggaagggacaaagggaacttcaactttatctgtaatgacctgtttattttgaaaactcaagagcaaaattgacaaaattttaacagtaacttaacaaaacctcaagtctggatagtgagttcaagagtgttactttatatggacaggcagtgactcatgcctacaatcccagcactttgagaggccaaggcaggaggatctcttgag

SEQ ID NO: 42266 - DNA, 137 bp, Homo sapiens
agtgatttatctaatctaagcaaaaatagtagaaggctattgtcttgtcacttaagttgaatgaatcccagtgattgtagttgcttcacgaaaaataaccaatttgttctacagaggtagtctgttcccagagattg

SEQ ID NO: 42267 - DNA, 471 bp, Homo sapiens
agaggaggtaaatcctcctaacactacataaatctaagcccatatatgtttaaaaagttcagtcaatagttgcctagggaagaaaaatcaacactatgcagagaaagataacagaattcagaatctatatatcaattataatatccaaaatataataaaaataccgtttctccaaataaatatgaaattttgactcatagccaaaaaaatatagcgagggaatagaaacacactccaagatggctcagatgtgagatttaggagacaaatcttagaacagtataagtgcattcgaggacttcaagaaaaatatggtctcaatgagtaactatataaagaacctcagcagagaaatagaaattaaaaatgcaacaaaatggaaatactaaacaagtgatgcaagaactgcagtggaaagtttacagtaggcttaatagtagctagattttttttaaatggaaagttaaatat

SEQ ID NO: 42268 - DNA, 455 bp, Homo sapiens
tcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaacggctgctgctaaggcacctacaaaggcagcacctaagcaaaagattgtgaagcctgtgaaagtttcagct

SEQ ID NO: 42269 - DNA, 123 bp, Homo sapiens
atccaaagacaacctcattccccctaaataaattaaaaaaactattaaacccatataacctcccccaaaattcagaataatgacacacccgaccacgccgctaacaatcaatactaaaccccc

SEQ ID NO: 42270 - DNA, 208 bp, Homo sapiens
gtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttcc

SEQ ID NO: 42271 - DNA, 100 bp, Homo sapiens
  misc_feature 2, 27, 39, 49, 52, 53, 59: n = A,T,C or G
cnggacctgtgacattctggactattnctgtgtttattngtggccgagngtnncaaccntataataaatcacctcttccgctgttttagctgaagaatcg

SEQ ID NO: 42272 - DNA, 475 bp, Homo sapiens
gtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacggcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatc

SEQ ID NO: 42273 - DNA, 157 bp, Homo sapiens
  misc_feature 157: n = A,T,C or G
cagaattgcaattccaaaatgtgtaaggcgggatattctcttctgtgctgtcaagggacatggatttgattgacatactttggaggcaagatatagatcttggagtaagtcgagaagtatttgacttcagtcagcgacggaaagagtatgagctgcn

SEQ ID NO: 42274 - DNA, 469 bp, Homo sapiens
  misc_feature 94: n = A,T,C or G
tgaaaggaggggaggcaacaagcaatggaggaaggagaagtatatgcaattgaaacctttggtagtacaggaaaaggtgttgttcatgatgatntggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaat

SEQ ID NO: 42275 - DNA, 469 bp, Homo sapiens
  misc_feature 9, 25: n = A,T,C or G
gaagacagnacacatgaccaacagnatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaag

SEQ ID NO: 42276 - DNA, 427 bp, Homo sapiens
attgattttggttttacaaataaattttagcaatcagacaaattcacaaatatggaatctgtgaataattagaattgagtatctactgaagctcctccatttttgtctttctgttctaagttgaggcttgattttagtcatagatttggttttagaaaaagtaaaattttaattctgtttggtttttgttcccatttttttaaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtaagtggtaatga

SEQ ID NO: 42277 - DNA, 471 bp, Homo sapiens
tgctgacactgtcctcccctgtatagatttgtcactcagaatttgggccttgaggaggctggagggtgtctacacatttatgaagcctgaggattgagacctcagacactgtctcttttatcctctatcgagatacttcagaaatgcttcactgcaagagacattcgctagggagcagttgtcccccacgccataggccactggctttacttgggaaaagaggttgctagaagccagaatggttgattctttgactacaactggagagggagggtgtggggaaaaaatagagaggactctgcttagctgttaattggtgagccaactcttggtaagctgtgtgatttatgttcctttccaccctccaaatgggtccagagattttccctttttttgaagtgctttttcaagtgtttgggatcccggctctcttcaacaacatggtttccatgccctaagaatgaataagag

SEQ ID NO: 42278 - DNA, 474 bp, Homo sapiens
accttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctg

SEQ ID NO: 42279 - DNA, 469 bp, Homo sapiens
aaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaacctt

SEQ ID NO: 42280 - DNA, 229 bp, Homo sapiens
  misc_feature 228: n = A,T,C or G
catcacacctggccaatttttgtgtttttggtggagatgggatttcaccatgttgcccaggctggtcccgaactcctgggctcaagcaatccatccacctcagcctcccaaagtgctgggattacaagcatgaggcactgtgcctcactagctgcccatttagtttgaaggtaataaaataatctatattccagattctgctgcttgtaaatcctaccattcatagtng

SEQ ID NO: 42281 - DNA, 207 bp, Homo sapiens
gcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcc

SEQ ID NO: 42282 - DNA, 386 bp, Homo sapiens
gtagaaaattgaggaaagaaaataaccgtaacaattataagaggttataaaaggttcatggaacctttttatgttttttcttgtgcagtcaaaaccaattgcaggctggatgcagtagctcacacttgtaatcccagcactttgggtggctgagatgggcagatcacttgagctcaggagtttgagaccatcctgggcaacatagtgaaactctctcactaccaaagtacaaaaggaattagctgggcatgatggtacacacttgtagtccagctacttgggggactgagatgggaaaattgcttgagcccgggagtcaaaggttgcagtaagccaagattgcaccactacactccagcctgggtgacaaagtgagaccctgtctc

SEQ ID NO: 42283 - DNA, 197 bp, Homo sapiens
ctagaataaatggaaaaatgttatcaggaggaagagactgctggactcccctgagaggtagggtttgtgctaggagagctgggtgccatttatttcattttgatatatcaggtgctcctagtaacaattcctagtttctcttacctctgtaatcatcctgaatagtcactgcttcttgagctttggtgagtgttctc

SEQ ID NO: 42284 - DNA, 468 bp, Homo sapiens
  misc_feature 13: n = A,T,C or G
aacagtgcaaagnaacaatgcctagcgtatggtgagtattcaataagtgtttgcctagaagaaaaaccaatattagagtgggaatttaaatttaggtctgccttacggtaatgtggtattatgctgtttcatatttgcctaatgactgtatattgtcctgtagggaaactatattgctttcataattacctccagatatacaatacagatcttttcatttatgcctgaagttcagacatttattcaacagacagttgtcttcctgctgtgcccttgatattgtgctaggcatggaagtacttctttgcctttagtcttcaattaaccttactagagctcttattcaaagactatgccaaaattttaaaaaattatttgtttatggtacttagaggtaatgctttattggagcgatataaaatggattggattcctttaccttcagactttaaagatacaataatgtga

SEQ ID NO: 42285 - DNA, 147 bp, Homo sapiens
gagtaatgaaatacttgtttttcatacaaaagaatatgcacacatatttaagttgttagccataattaaaaaatagtaaagagataacaccctgagtgtatcatccaacctgaaaaaatgaacattacctgagcacaagtcagtgac

SEQ ID NO: 42286 - DNA, 464 bp, Homo sapiens
  misc_feature 152: n = A,T,C or G
caggctagactgcagtggcacaatctcggctcactgcaacctccacctccggggttctagcaattctcctgcctcagcctcctgagtagctgggattataggcgcatgccacacctggctttttgtattttagtggagatggggtttcactngtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctggcaaaacttaaaaaaacgtttccaagaatcagataaaagaggacaaaccttagggagaagaaggcagctgctcatttccagcaggggaagtagctgcatagagtacaaggactggtaggcctgttggcttgttcctgtttaaggag

SEQ ID NO: 42287 - DNA, 257 bp, Homo sapiens
atagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaaga

SEQ ID NO: 42288 - DNA, 206 bp, Homo sapiens
gattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttg

SEQ ID NO: 42289 - DNA, 469 bp, Homo sapiens
  misc_feature 7: n = A,T,C or G
atcgganaacttacctcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtat

SEQ ID NO: 42290 - DNA, 241 bp, Homo sapiens
gtttgagttttgtttttgtttttcctggtaattttgtgttccataatttctcagacacagaaacattatctttcaaattttaataccactttatttgactcaatcacatgtaaaatttttgttcagagaattttgaatgtatccgtgaaaaatattcaaatgtcgaaatccaaatgtcttgctttggctgtggagcaatatcattactgtgacttagttctagaatttagacttaattgcg

SEQ ID NO: 42291 - DNA, 287 bp, Homo sapiens
  misc_feature 15, 52, 54, 66: n = A,T,C or G
atgtccgggaagaancttaaaaacaatgaaaacccatacttttgaaaagggngncttttaaaaatnaagtttgatcttttgggaaataaagcacatagttttcaaaatgatttaccaagatctatgctctttcaaatggagactgggatattgttgttttgagaccactgttttcctgttccctcccaaatgttagtcacatatatgattacccttaagttggtcactatctatctatctgtcaataatttaggattaaagtttgaagtgtaattacatttgacttt

SEQ ID NO: 42292 - DNA, 259 bp, Homo sapiens
  misc_feature 13, 29, 40, 50, 59, 90, 117, 136, 237, 243: n = A,T,C or G
actgctcccgctnctgaattcactgctantcagcctgagntgcagactgntctgaaggngtacaaggtgccctctgtgcctattcagcanttccctactgaagactggagcgctcancctgccacggaagactggnctgcagctcccactgctcaggccactgaatgggtaggagcaaccactgactggtcttaagctgctcttgcataggctcttaagcagcatggaaaaatggtngatggnaaataaacatcagttt

SEQ ID NO: 42293 - DNA, 362 bp, Homo sapiens
  misc_feature 7: n = A,T,C or G
agagtcnactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcac

SEQ ID NO: 42294 - DNA, 467 bp, Homo sapiens
gagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggtttt

SEQ ID NO: 42295 - DNA, 482 bp, Homo sapiens
agtgaagttaggaagcatggagtccacagtgttctttgaaagaatcaaggcaccaagtccatgcatttacatttctctcttgagatcagtccttttgttagcagcctgcaattctgaccacggcaaccaaaaatttctgaccgtggcaaccaaaaatcaagcgcgaggaaacctgggggtttatttggaggtgggagaggatgtcccttcttctggtaggactatgtctggctacattgtctttccatttttttctgattgtccccttgcccccctcccttttctgggggcacagagggcatggcaattttgtttcctagctttccatattcctactgcagtgctttcttcagaatacttgttcagatcggattcttggctgtgagggcaaccagctgctttcctgtttctttagaagtggatcccacactgccgtgtcctgcacagtgagttctgcgttgtagaaaccatctagcagtggt

SEQ ID NO: 42296 - DNA, 469 bp, Homo sapiens
tgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaag

SEQ ID NO: 42297 - DNA, 479 bp, Homo sapiens
  misc_feature 373: n = A,T,C or G
cagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaanggatggcaatgccagtggaaccacgctgcttgaggctctggactgcatcctaccaccaactcgtccaactgacaagcccttgcgcctgcctctccaggatgtctac

SEQ ID NO: 42298 - DNA, 253 bp, Homo sapiens
agagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaaagaaaaga

SEQ ID NO: 42299 - DNA, 477 bp, Homo sapiens
attgatttgcagttaaaaagaaggtggggatgcctctgctggtgcagtatcttgtgaagataaatagactcctgagtggtgaattctgatctctttcacgttcattcttaactttctattttagtaataatcatagttaccattgattataagtacccagcactgtgataaattgaattcacattacatttataacactttctaattcaaaacacagtcacagtagagtttttatcaatctgtacactggtaagcgatggtaaaattatggccctgatagcttcacagactaatggaaaatttctgaaagtttacaagtacagaaaaacaaagaaaaaaaacccagtcttttataaggaatgtagatacagaccattgtacaatttaaaatatacataatgtcagtcttttctttgtatggcaaaaatgacatttgggaactgctcatggtgactcaacgcttgtaatgtaatccca

SEQ ID NO: 42300 - DNA, 154 bp, Homo sapiens
  misc_feature 13: n = A,T,C or G
agatgaaatgatnagagaagcagatattgatggagacggacaagtcaactatgaagaattcgtacagatgatgactgcaaaatgaagacctactttcaactcctttttcccccctctagaagaatcaaattgaatcttttacttacctcttgcg

SEQ ID NO: 42301 - DNA, 105 bp, Homo sapiens
atccttttgtagttcatgagcgtgatgattgggtgttcatacgcttgtgtgagatgtgccacccttgaaccttgttacgacgtgggcacgttacccgtctgaccc

SEQ ID NO: 42302 - DNA, 470 bp, Homo sapiens
gagtaaatatctttccatccgaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcacttttt

SEQ ID NO: 42303 - DNA, 238 bp, Homo sapiens
  misc_feature 237, 238: n = A,T,C or G
aatcccggcattttgggaggctgagacaggtggatcatttgaggccaggatttcaagaccagcctggccaacatggtgaaaccccttctctacgaaaaatacagaaaaattagctgggtatagtggcgcaggcctgtaattccaactactggggaggctgaagcatggaggttgcagtgagccgagttcatgcccctgcattccagcttggcctacatactgggcgagactctgtcnn

SEQ ID NO: 42304 - DNA, 476 bp, Homo sapiens
  misc_feature 9: n = A,T,C or G
gtctgaatnaatgattttgattaaaccctgtaactctgaggtccattataagaggagacctagttaatacctatatggtaaatgatattatagtggaagttagaattatttgggattttgttcttaggtggttgaagttcataggtgtggattgtattactagaaaagatttagtaaatgaaaaatgaaacaaatatgtaaataaaggaagacaagtagagccatatgttgcctaattatgagaatgtataatgtatttattattattaacacacttctgaagcactcagtttcaacataaattgattaaatctgatacctatttgggtaaggaatatacatacagagacaagtacctagaaatcagtattgtttgtcctgcattatttagatgttgctgtttcttaatgaacacaagaaaatatgatctagtctgggaatcatgagcaaatgacaggtgttaacgccattcatat

SEQ ID NO: 42305 - DNA, 459 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaaga

SEQ ID NO: 42306 - DNA, 500 bp, Homo sapiens
  misc_feature 32, 45: n = A,T,C or G
tatggaccgggaagttgaagtaaatccaaagngtgaagatgcagntggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacag

SEQ ID NO: 42307 - DNA, 390 bp, Homo sapiens
  misc_feature 5: n = A,T,C or G
aaagnagcaagggtgccttagacttaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaaga

SEQ ID NO: 42308 - DNA, 178 bp, Homo sapiens
gtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtc

SEQ ID NO: 42309 - DNA, 150 bp, Homo sapiens
catcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatatt

SEQ ID NO: 42310 - DNA, 244 bp, Homo sapiens
atttctaccaagagctcctggtgattctgattattagtaaaaattagaaaccacttattccaaagcctctttaaacaaagtgtgttctatgggccaaccaaatctcctgggaatatcttagaaatgtagaatctcagtggggccccaccacacacctactgaattacagtctgcattttaacacggtcttcagttaatttatgctcattaaaatttaagaagcactgtagtaaacgctactatt

SEQ ID NO: 42311 - DNA, 269 bp, Homo sapiens
aaggaaatgaccaccggtaagacctgtgttgaagggaaaaacatcaattggtctctttgccaagttcaagtccagtaggttttctggatgtgtagtcaagaaactagcatctcattcttgcccggctcctaaagagctgggtgaccctgggtacctagtcaccacagtgttaggtgggactagtgaaatgcaaatactgagaggaggattggttcatccaagtctttaccacaatttagtgagtaatagaagaagcttaaaagatgttg

SEQ ID NO: 42312 - DNA, 346 bp, Homo sapiens
atggttgaatgctgttctatcatatggatagaacacattgggtttattcattgttttttcagtgtacacctgggttgttcccaccttttagctattgtgaataatgctgctatttggatactggtgtacaaatatttgctataatccccattttcagttcctttggatatatatccaggagtggaattgctgaatcatatggtaattgtatgtttagctgcgggacagacccccatactgttttccacagtgactgtcccgttttacattccctgcagcaatgcacaaaggctcccatctccccacattctcaccagtgctgatgctgctgctgctgctgttgctt

SEQ ID NO: 42313 - DNA, 240 bp, Homo sapiens
  misc_feature 15: n = A,T,C or G
caaagacttttaatntgggccagaactttcactgacttgaaagtaacttctccacagggaaggaccaaaaacctggtttaccttaaaacaaaaacctgttggagttcagcgtggtgtaaaaatgtaaggaagcattgataaattgtctaagtttatccatttgaaagaaattgtgtaagattatgatattctcttttctttaaaaaaaaaagtacaataaaattcaaacattccttagca

SEQ ID NO: 42314 - DNA, 325 bp, Homo sapiens
attgaagatattttgggtgttaaaaaggaaatgatccgactagatgaggtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaaggtaaagtctccaagttctcagaattttgagattatagctctgaggcccttactaaatcatctagttttttttctttttcttttcttttct

SEQ ID NO: 42315 - DNA, 186 bp, Homo sapiens
atgtgaaataatgattttccccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaatgcg

SEQ ID NO: 42316 - DNA, 467 bp, Homo sapiens
  misc_feature 5: n = A,T,C or G
agttnagtaccaccagacctatcttacaagaattgctaaatgaaattctcaaagcttaaagaaaaggatgctaattactaccatgaaaacaggaaaatataaaattcactggtaaaagtaaatacacagtctaattcagaatattctaatcctgtaatggtgacatgtaaatcacctgtattttcagtatgaaagctaaaagacaaagctattaaaaagtagtaataactacaataattatttaaggattacacagtgtaaaaggatgtaaattatgacatcaaaaacataaaatgtgagtgatatggtaaaagtgtagcatttctgtatgtagtcaaaattaattttatcagtttaaaatagcctcttttaactgtaaggtgtcttgtgtaagcctgctggcaaccacaaagcaaaacctctagtaaatgcacaaataagaaaaagtagggaatcagaacatacta

SEQ ID NO: 42317 - DNA, 472 bp, Homo sapiens
caagaagccaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattc

SEQ ID NO: 42318 - DNA, 191 bp, Homo sapiens
caggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttc

SEQ ID NO: 42319 - DNA, 274 bp, Homo sapiens
aacacaaaaaacaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttac

SEQ ID NO: 42320 - DNA, 470 bp, Homo sapiens
gcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcattttagaagtcagagcaaactagggtctcagtattgagaaacgcagcctgccagggaatcacagagacatcggggtgcccgcgat

SEQ ID NO: 42321 - DNA, 383 bp, Homo sapiens
ctgtgaggggaagtcagtctgacaggctgagttgcctttcttgtccttggcattgtaacactgcacagtcttctgttgtttctggaaccactcaagcatataatgaatggagtaccactgattggaaacgttcggccctagatgatatttccgcaagttgttttccttctacaacttggcaaccccttaagaagcaggacatggaatattttgtcattttcattctgaggaacagactggttgggtgcactaggcagctgatatgatgggaaatcctgctgtccatgaaagaaagttaatggatttttataatggtgccaatcgtatggtagaaattatcctttcaatattagagaatttgattaaaggaattacgtgaatta

SEQ ID NO: 42322 - DNA, 167 bp, Homo sapiens
  misc_feature 2, 4, 22, 77: n = A,T,C or G
ancnaaaaactgagtgactctntacagctgatcagttttttcacctggaagcctttgtttctactttgatactgacngtttttcggacagtttactttgttgagagtgtgaccaaaagttacatgtttgcacctttctagttgaaaataaagtgtatattttttctg

SEQ ID NO: 42323 - DNA, 405 bp, Homo sapiens
ttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgctaagactgagtg

SEQ ID NO: 42324 - DNA, 285 bp, Homo sapiens
agagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttt

SEQ ID NO: 42325 - DNA, 120 bp, Homo sapiens
atcctaggcatctgctgtaataatattttagaaaatgtttggaatttaagaaataacttgtgttactaatttgtataacccatatctgtgcaatggaatataaatatcacaaagttgttt

SEQ ID NO: 42326 - DNA, 249 bp, Homo sapiens
gagtggggagcttgcttgggaaaaatcgcagggtccacagaaatgaaaggggatgtaccgtatgggactagctggggcatgaaagtggatgacttctagggaaatcacatggagaggaagaggggctgaacacagaatcccagctgacaccaacggttaagaaatgggaagatgagaagcctgggaaggagagggtgtaggaaaactgggaatgaatcatacacaaaagttagattaagaaagagtgac

SEQ ID NO: 42327 - DNA, 445 bp, Homo sapiens
  misc_feature 392, 394, 433, 439, 445: n = A,T,C or G
atttgggagctggatcattagttgggatgtgactggctttccctggggagcaaaaaggagattaacagaggttttgctcgcttcttcctgtgatttactgtgggaagtctcccaggttcttcccttcgcttctctgtggccttcatcttcatggtttcttgctgtgtctctctgagagcaagtacctgggtgaaaaaggctgagtgtgtggttttttggcaactgcctggcattggatttaagtgggtatatttgaattactagaattttacattttataggttcaaaatatgcacttgaattctgtaggacctcttacccaaattgaataatcctttgtgccttgttaaattttaaaaagtcacactatcaacattatgacatatggcatntntgatggccattattaaaaattaccccccctttttgggcncctttnaatggn

SEQ ID NO: 42328 - DNA, 461 bp, Homo sapiens
  misc_feature 18, 340: n = A,T,C or G
gggacgaagcacagcagnatgtggaaaggaaggaataaaaatgcccaagaccaaacgaaagaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtacccatgtatgataaagggatgtacttcagttgttacaagtgaaagcaatataattagacattataagtgccataaattatctaaggcatttacatcacaacaccgaaatcttcttattgtattcaaacggngttgcaacctcacaagtaaaggaaacgtctgagcaagaaggtgctaagaatgatgtgaaagattctgacacgtgtgtatcagagagcaatgataattcaagaacaacagctacagtttcgc

SEQ ID NO: 42329 - DNA, 221 bp, Homo sapiens
tgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaagttttattttcagttccttttgcatgcctattttgatttagaaatcactttaagataaatgaacaaaattat

SEQ ID NO: 42330 - DNA, 472 bp, Homo sapiens
aaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggcctgcttc

SEQ ID NO: 42331 - DNA, 469 bp, Homo sapiens
aggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaac

SEQ ID NO: 42332 - DNA, 442 bp, Homo sapiens
atagtaatatagatattaaatacacaggacaatttttataaatttatctctaaatgaaataattatgcccatttttaccattcaaagattataccatgcatgtgtacacatatgcgaggaaaaatattttgatagtacaaagtttttgaatattagagaagaattagtagaaagataattttgttgaggcataaagcatatttagtgtaactactttgactgttgtaataaaatcacccagattttgtgacagtagctgagattaaaaataaacagtagagagaatttcacttgttaataatgctattaaaagatgaagcttatacactttataattgcacagagtatttgtgtaagttcatataaaagtggaataaaattaaacagccaaaaagagagtattctttgctagaggtcacttttggggtaatttttagaatgt

SEQ ID NO: 42333 - DNA, 415 bp, Homo sapiens
atgtgatggtgtccaccttcccaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcactttttttttccaccctggctccttcagacacgtgcttgatgctgagcaagttcaataaagattcttggaagtttta

SEQ ID NO: 42334 - DNA, 466 bp, Homo sapiens
cggccggaaccgcctcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaagggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatg

SEQ ID NO: 42335 - DNA, 409 bp, Homo sapiens
ttgtagctccagagtatgtagatctcagaccatagaaatttcactcttttcccagaagggaaaaaagaaatgacagatataaaagaattttttccaagctggtaagtggtttctggaaaattagcaagttgtgatatgtaggttgagcatcccaaatccaaaaaatgaaatccagtgagcttcaaaatctgaaacttcttgagtgctggcagcatttaaaggagatgcttattagggcatttcagattttggtttctggatttagggatgctgaaccagtaaattataatgcagacacttcaaattttgaaaaaaatcggccacctgtaatcccagcacttcggaaggccaaggtggttggatcatttgcatccaggagttcaagaccaccctaggcaacaaaaaatgt

SEQ ID NO: 42336 - DNA, 454 bp, Homo sapiens
gtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtgggttcagggccagtgcatattagtgggacagcacttagtagct

SEQ ID NO: 42337 - DNA, 230 bp, Homo sapiens
caggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtaca

SEQ ID NO: 42338 - DNA, 274 bp, Homo sapiens
catggtggcttacgcctgtaatcccaatactttgggaggccgaggcaggtggatcacttgaggccaggagttcgtgactagcctggccaacgtggtgaaaccccatctctactaaaaatacaaaaattagccaggcatggtggcgggtgcttgtaatcccagctactcaggaggctgaggcagaattacttgaacccaggaggcagaggttacagtgaacccacatcctgccattgcactccagcctaggcgacagcagcaaaactctgtcgcg

SEQ ID NO: 42339 - DNA, 420 bp, Homo sapiens
caaagctttctgaatatgaccgcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaac

SEQ ID NO: 42340 - DNA, 250 bp, Homo sapiens
cccagtcaagaaaggcaaccgagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttac

SEQ ID NO: 42341 - DNA, 334 bp, Homo sapiens
gaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaagc

SEQ ID NO: 42342 - DNA, 276 bp, Homo sapiens
catggtggctcacacctgtaatcccatcaatttgggaggctgaggcaagcagatcacttgaggtcaggagttcaagaccagcctggccaacatggcgaaaccccatctctactacaaatacaaaaatgagccaggcgtagtggcgggtgcctgtagtcccagctactcgggaggctggggtgggaggatcgcttgaaaccaggaggcggaggttgtagtgagctgaaattgtgccactgcaccccagcccaggcaacagagtgagactcagtcttc

SEQ ID NO: 42343 - DNA, 407 bp, Homo sapiens
tagtcatagtggttccctgggaagccccagaccctttgacttgtgacattactggtttgcagacataataactacactcagaggaccatggaggcagagggatcatggtttcagggcactgaaaactctacgagccaagaggactagtgcatggactgaaagtcaggcatgccctcaaataggctgtattttctttccaggaatgtaacctttcccctttttcttctgacctgagccaagattggaaatcagaaagtctcctgtacatggagctgaagaggggctgctgttttccgaatgttttccatttcacaggcgccacctgcttgcccggggttggtcttgagaagacacccaaatgttcatgcctcagaaaggcagcagaatgccttttaggaaattttttt

SEQ ID NO: 42344 - DNA, 473 bp, Homo sapiens
  misc_feature 6: n = A,T,C or G
aatccngcactttgggaggctgaggcaggcagatcacttgaggtcaagagttcaagaccagcttggccaacatgatgaaaacccatctctactaaaaataaaaaaattagctggacatcgtggtgtgtgcatgtaatgccagctactcaggaggctgaggcaagagaatcgcttgaaccctggaggtggaggttgcagtaagccaaggtcacaccactgctttccaactgggtgacagagtgagactctgcctcaaacaacaacaggctgggcgcggtggctcacgcctgtaatcttagcactttgggaggctaaggcgggtggatttcctgagctcaggagtttgagaccagcctgaggaacatggtgaaaccccgtctctactaaaaatacaaaaaggtagccaggcgtggcggcatgtgcctgtaattccagctacttgggaggctgagacaggagaatcgcttaaacct

SEQ ID NO: 42345 - DNA, 407 bp, Homo sapiens
  misc_feature 274, 404: n = A,T,C or G
attgaaggtgttgttgctgatacctccccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagngttataccttacccaatgaaagcaaagtttttatgtgctgtgcaaatggtcttcatgtggtctgacaatttatttttgccatcatttttttaattaaagaaaaaatttccagaaggggaaaaaaaaactncga

SEQ ID NO: 42346 - DNA, 470 bp, Homo sapiens
tgtctatatgtgacttcgggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttcca

SEQ ID NO: 42347 - DNA, 467 bp, Homo sapiens
gtctcatctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcgg

SEQ ID NO: 42348 - DNA, 398 bp, Homo sapiens
  misc_feature 11: n = A,T,C or G
acacagaggcnggccttagcgtggctcagccatgagcaacaggagtagcttttcccggctcacctggtgggtatcactgtgccgagcgctgttggctctcggggaacctagaagtgtggaaacctaacacatcctgtgtctctaaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagtacctggaggaggagatccgtatcagatccgccgacgactgcaagcagtttcgggaggagttcaactcattgccatctggacacatacaaggaacttttgaactggc

SEQ ID NO: 42349 - DNA, 358 bp, Homo sapiens
acaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagc

SEQ ID NO: 42350 - DNA, 472 bp, Homo sapiens
  misc_feature 14: n = A,T,C or G
gaaacaatagtgcnccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggcttcccagctggcgtgtatgtt

SEQ ID NO: 42351 - DNA, 440 bp, Homo sapiens
aacccagcagaggttcacctgttacggctccaatccagcctaaacttcattcccaccttccacttccacccctgcctcccctagttttgacagcctccttgttcagagagaagcagaagttaataggggggaaagatctatgcttccaatcttttcaaataggaagaattgaacaagttgagtattactgagatatgaaagcaactggttaaaatagtttatatctgaaacaaatttcctttgtgcacagatctttacactatagtattagaagatttttttccccaaagagatctttagaatatgttccatgaaaaatagaggtaggccgggcgtggtggctcatgcctgtaatcccagcactttgggaggccgaggtgggaggatcacgaggtcaggagatcaagaccatcctggctaacacggtgaaaccccatctt

SEQ ID NO: 42352 - DNA, 243 bp, Homo sapiens
  misc_feature 202: n = A,T,C or G
gaaagatgtaaaattgacaccctaacatcacaattaaaagaactagagaggcaagagcaaacacattcaaaagctagcagaaggcaagaaataactaagatcagagcagaactgaaggagacagagacagaaaaaacccttcaaaaaatcagtgaatccaggagctgtttttttgaaaagatcaacaaaattgatagaccgncagccaggacttattaaggaagaaagaggggaggattccat

SEQ ID NO: 42353 - DNA, 471 bp, Homo sapiens
agcccagttctgtgccggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggagggaagaggaacaagatacccttgaactggagctagttttggaaaggaaaaaacaat

SEQ ID NO: 42354 - DNA, 331 bp, Homo sapiens
gagatgcgttgttacaggaagtcccttgccatcctaaaagccccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacct

SEQ ID NO: 42355 - DNA, 366 bp, Homo sapiens
cagccttgacttcccaggatcaggtgatcctcccatctcagccccctgaatagctggactacaggcaaatgccatcacgcctggctaatttttatatatttagtaggaatggggttttgctatgttgtccaggctgattgcaaactcctgggctcaactgattcttccactcagcctcccaaagtgctaggattacaggcgtgagccaccacacccagcctcaaactagtactatttcttaacacatctctgaaactgtcaggacttacttgatgatgctctctggaatgtggatgcaatccattgggatcagcccactgagttctgataagctattgacatatttaattttactgctgaattttg

SEQ ID NO: 42356 - DNA, 472 bp, Homo sapiens
gtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcact

SEQ ID NO: 42357 - DNA, 165 bp, Homo sapiens
  misc_feature 161: n = A,T,C or G
atgtaaaaggtcgtaagcttcaacacataaagcaaaacatgtcaattcttgattatgaccctaaactgcaattatccagccatcagcttgtaaatatttacttagttgatttgatccttaaatgttttataaataaatcacaataaatccaatgttacaangatt

SEQ ID NO: 42358 - DNA, 202 bp, Homo sapiens
attgagtagacatggacacaaagaggggaacaatagacacttaggcctacttgagggtggagggtagtaggagggtgaggattgaaaaactacctatcaggtattatgcttatcacctgggtcacaaaataatctgtataccaaactcccatgacacgtaatttacccgtgtaacaaacctgcacatgcaccccctgaacct

SEQ ID NO: 42359 - DNA, 432 bp, Homo sapiens
  misc_feature 379, 386: n = A,T,C or G
cagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggtatgtgcagaggccagaaccaagatgggatttccctgctgaactatgtgagatgctgcatttctatgttgtgtttgctctgatgcagcagtaagtttcttgattcatttagaccagcacattaaaaaaaaaaaattgagagcagcataatctcaaaacacatgcncacaatntaaagggtttatgtaatttagaatctggaacaaaatgtcataggat

SEQ ID NO: 42360 - DNA, 380 bp, Homo sapiens
  misc_feature 338: n = A,T,C or G
agccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaatngacaatgtcaataaattgaaatatggttcactgttactcttg

SEQ ID NO: 42361 - DNA, 237 bp, Homo sapiens
cagacacgggtgaatgctgctaaaaacaagactggggctgctcccatcattgatgtggtgcgatcgggctactataaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttcca

SEQ ID NO: 42362 - DNA, 141 bp, Homo sapiens
agctgctagaaatgttaatgtacgccaggtgcggtggctcacacctgtaatcccagcactttgggaggccaaggcaggagaattgcttgagctcaggagttgaagactagcctaggcaacatagtgagactctgtctctac

SEQ ID NO: 42363 - DNA, 254 bp, Homo sapiens
tcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaat

SEQ ID NO: 42364 - DNA, 296 bp, Homo sapiens
  misc_feature 293: n = A,T,C or G
atccgagaggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccngtc

SEQ ID NO: 42365 - DNA, 346 bp, Homo sapiens
ctagaaactgtaaattaacaaagagctaagcctcttctcctcacaacccctccaggacacatacagagagcatcagacctagatggttccacacgtgaattctaccagaatttcaagtatagttaatactttcaaatcgttttcttatgccagcagaactataatggtaatatgtaacagaaataacataaaatagacaaaatttgcttatgaataccagtgcagaaatactaaataaagtattaacatgcagaattcaacagagcattaaaggaatataccacaagcaagtgggattcataacagacattaaataatgcttctacattaggaaatcttttaatag

SEQ ID NO: 42366 - DNA, 284 bp, Homo sapiens
  misc_feature 10, 11, 22, 168: n = A,T,C or G
gcaggtactnnttatccaagtncaaagctagtaagtgacagagccaggcctcaaacaagatctttcagtccctgcaacattaccaacaacagtgtgtttttgccagtgaaaattttgtgctgctgaaaagagaataaacattagtgatcacattgaaatgtggattangttaaattctcatattacagacaaagattcctgtaatacataaaagagcaaaaataatacataaatggcatccaggtggatgctatttacaatagatatccctaaaataaaatcac

SEQ ID NO: 42367 - DNA, 239 bp, Homo sapiens
atagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagcttcaccgttaccgctaatataagtaaagtttgtaaaattcatacttaataaacaatttaggacag

SEQ ID NO: 42368 - DNA, 109 bp, Homo sapiens
gacccagagcattcccagctctggcttaactggatgccataagacaaccctggttcctttgtgaacccttctgttcaaagcttttgcatgcttaaggattccaaacgac

SEQ ID NO: 42369 - DNA, 383 bp, Homo sapiens
  misc_feature 189, 203, 219, 318, 325, 362: n = A,T,C or G
agaacagctgactgtggaagggtaaaatgcagagaaccagtcattggatctcccttctctactttgttactgaaatcttgaacctgtagaacattacttatcactgtgttcctttctaatgggaaaataataataaacacttgcagagtattttttaaaagtttttagctttaaaaaaaaaaaccctgngccttacacaatgngtatattgagttgatnctgattatgataattagatggtattatacaatcattcattcagcaaacattcacttactgagcacctactaatgttccaggtactgattgttaaaaggngattganacacagcctctgtcctgagcttagtctagtaggaggngacagatttgtaaataataga

SEQ ID NO: 42370 - DNA, 482 bp, Homo sapiens
agttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcag

SEQ ID NO: 42371 - DNA, 321 bp, Homo sapiens
  misc_feature 176, 186, 195, 235, 273, 305, 311: n = A,T,C or G
acagacgaggcagctgagtctccaagctgatgagaattccacaaggccatagagctattaaagagcaaaccttttactgacaaatgagtagtacttattcaacacgtttcataattttgaaaaatgaatgttaaacctcaatcttttttgtttttaaatacccaacttggaaagtntttgtcttangaaaatgtngtggaaagcaaaacctactcatacccagttcacactattnttccactctgctagattgagggcagcctgccatgtgtncagataggaaaggaagagagaggcccactctntgctgnaatgacaatg

SEQ ID NO: 42372 - DNA, 389 bp, Homo sapiens
  misc_feature 144: n = A,T,C or G
gaaactaaatgatgtcctttggatttcacagcagaatttgtaagataataacgaggccccagcggttcagtgagtccccattagtgttctcaccaggccccgcagtttcccctggagacaactctgagctttgaagggcatcangatctttcaagtcattgtcgctaatggaaatggggaatttatttacttgtaaattgcactttaaaaaatttcagtcccccactggacatcttcaatttccccaatttcaacatacagcctcatttatggacaaaattaagctcttcaacactatgcaagtgtttatgtgcaccttttcacactgaaaggaaaaggggaaatggacacttgtatgctacatagttttattttattttgccatgttg

SEQ ID NO: 42373 - DNA, 329 bp, Homo sapiens
attgaaatgaaattgaaagatgagatgaaatgatgagatgaaatgaaatgttgaaatgatgaagagatgtgacatgaaatgagctgaaatgagatgaaatgaaatgagattaaatgatgagatgaaaaatgatgagatgaaaaatgagatgaaatgatgagatgagatgagatgaattgagatgagatgagatgaaataatgaaattaggtgaaataatgaaatgagatgaaataacgaaataaaattgaaatgagatgagaggaaatgagatgaaatgttgaaaagaaaggattgaaatgaaattgaaagatgagatgaaatgatgag

SEQ ID NO: 42374 - DNA, 143 bp, Homo sapiens
agctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctc

SEQ ID NO: 42375 - DNA, 450 bp, Homo sapiens
  misc_feature 13: n = A,T,C or G
tggtaataaagtnggaagaatgggcctttgtccttaacaatttcatggtctggaggcacaggggaccagtaaataggacaagtgcatgggtatagtagccctgccgtaggagaaatgtcatggggcttctgggaggcattgctgcaccactcatgagtgccaaagaagacaactgggacttggaaaggtcacttcacaatgaagagataaagactaaaaggagctaaaagtagaataaacatatacatatagaatatttacaaatattgacaatgcattttgttttaaaaatagacaaattaaacaacccaaatggctaatgaatgtgacaaatcacagacatgtatattaaacagacctggggagaaaatgaataataatggagggtggggattcttggcaaagggagcatctgaagtaaagatgtgaggtgcgatgatggtgttgaga

SEQ ID NO: 42376 - DNA, 219 bp, Homo sapiens
gtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatat

SEQ ID NO: 42377 - DNA, 408 bp, Homo sapiens
  misc_feature 17: n = A,T,C or G
atgtttagactttaacntaagctatttttctaactacaaaggtttaaatgaacaagagaagcattctccttggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatggggtgttatcacctagctgaatgtttttctaaaggagttttatgttccattaaacgatttttaaaatgt

SEQ ID NO: 42378 - DNA, 467 bp, Homo sapiens
aaaaggctaaattgaaacaaaaatgtatttatattatatactacatatattccattcaaagctacaatactagtttctgagtcaccaaatgtggaaattaatgtcaatatgatgaaaatacaattttggaaaatttatctgtttttaatacctatatattcactttaacactcaatatattacatttttaataagcactaatgatattaatagtaatttgaaagaaacatattacaaagttttgtaaagaaagcattaaaataggtttttggaagattaaccttgaggcattatttcagtctgctttccaattacatattggaaagaggggtacagcatctactttttaatgctgctcttactttggtaagaatctaggtagtgggtaaaaaataaaatcatttgaaatagttttttatttattgaacattttttaggctgtacctataaaatatctttatagcaat

SEQ ID NO: 42379 - DNA, 144 bp, Homo sapiens
acatttgaaatacaggcttctttacataaactgagaggttatacaaaactcagtttcacaagggaacaatctatacctttctaaaagttaatatttcaagtctctaataggcagaatattttactctttaaaatcctgcctttc

SEQ ID NO: 42380 - DNA, 394 bp, Homo sapiens
ctaccttataaggacggcaagctgatcaagaacaatgcctccactgactatgacctatctgacaagagcatcaaccctctgggtggctttgtccactatggtgaagtgaccaatgactttgtcatgctgaaaggctgtgtggtgggagccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttcca

SEQ ID NO: 42381 - DNA, 140 bp, Homo sapiens
  misc_feature 25: n = A,T,C or G
gctgcgggtgagtgaaggacacatncgttcagtgtttcaagtacaggcccacaaaacggggcacggcaggcctgagctcagagctgctgcactgggctttggatttgttcttgtgagtaaataaaactggctggtgaatg

SEQ ID NO: 42382 - DNA, 196 bp, Homo sapiens
gtgcccagggctgcgtctgcaaaggggcatcggagaagtgcagctgctgtgcctgatgtgggaacagctcttctcccatatgtaaatagaacaacctgcacaacctggatttttttaaaaatacaacactgagccatttgctgcatttctttttatactaaatatgtgactgacaataaaaacaattttgactgtg

SEQ ID NO: 42383 - DNA, 471 bp, Homo sapiens
gaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgact

SEQ ID NO: 42384 - DNA, 123 bp, Homo sapiens
cacactcagtcccccaccacactgaatctcccctcctcacagttgccatgtagaccccttgaagaggggaggggcctagggagccgcaccttgtcatgtaccatcaataaagtaccctgtgct

SEQ ID NO: 42385 - DNA, 101 bp, Homo sapiens
aagaagaggaagataaaacagagctcactctgtctctctctctcattctctccaccatgtgaaggcacaggcaaaatgtggccctctgcgagcaaggaatg

SEQ ID NO: 42386 - DNA, 473 bp, Homo sapiens
  misc_feature 15: n = A,T,C or G
agtgtctgttgattnagacaatacacagtgagaaaagacttccattttagtaaacttattaatcctaatagcatctgtatatatttgatatattatgtgataatatgtaatatctatttgataaatcatagttatttaataatgatgatattacatattaaatcactgtactggcaatacataatgtacacatagcttgccgagctctatattatgatgccaggtaacccacagtgtggactccactgtatatatgaacatcacatgcataaatgttaagcacagatagcacatatggaaaaatttgaaatgagctaaggttaaagaagatgctaaagagcaggtaccaagaaatctcagaaagcggactgaagtgttaaataaagaatgtttggcttgggaagcaatctgggcttaaattgaatgcattttatttagtgactggaaattttttgaagttcaaaaatttttta

SEQ ID NO: 42387 - DNA, 472 bp, Homo sapiens
  misc_feature 5: n = A,T,C or G
attcncgggacactgtcaacctctataccgctctggctgcctctgccctccacttaatgctaatgagggatatatcctcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccct

SEQ ID NO: 42388 - DNA, 444 bp, Homo sapiens
ctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 42389 - DNA, 125 bp, Homo sapiens
aggtctttgaaattattattattatttgagacggagcctcactcagtcgcccaggccagagtacagttgcagtgagctgagattgcaccattgcactccagcctggctgacaagtgaaacaacat

SEQ ID NO: 42390 - DNA, 283 bp, Homo sapiens
aggtagggacaagatggtgccaccggtgcaggtctccccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgc

SEQ ID NO: 42391 - DNA, 443 bp, Homo sapiens
caatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtgggttcagtttgctcgatctgctaga

SEQ ID NO: 42392 - DNA, 314 bp, Homo sapiens
gatttttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgcactctttctgactacaacatccagaaaagagtcgaccctgcacctggtc

SEQ ID NO: 42393 - DNA, 405 bp, Homo sapiens
aagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttattgtaagtgcttaataaaaataaaac

SEQ ID NO: 42394 - DNA, 110 bp, Homo sapiens
gattacctgatcctgaaagtccagatgattctgaaagcgattcagagtcagagaaagaagaatctgctgaagaactccaagctgctgagcaccctgatgaagtggaggat

SEQ ID NO: 42395 - DNA, 206 bp, Homo sapiens
gtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacaca

SEQ ID NO: 42396 - DNA, 471 bp, Homo sapiens
gtctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatg

SEQ ID NO: 42397 - DNA, 323 bp, Homo sapiens
atctcagtgaatagggagaccaaggagagggagagagatcggggaacagttgggtggtagaagagtcagaacatttacatttattgattaagttcactgtcttacatgggcacagttcctggtgcccccaaacagttacaacagcgacatcaaagatcactgatgccagatcgcaataacacatataataataaggaaaaagtttgaaatactacaagaattaccaaaatgtgacacagaacatgaagtgaacacatgctgttggaaaaatggtgccgatagacttgcctgacacagggttgccacaaaccttcaatttgttt

SEQ ID NO: 42398 - DNA, 472 bp, Homo sapiens
  misc_feature 8: n = A,T,C or G
cacctacnctgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacag

SEQ ID NO: 42399 - DNA, 409 bp, Homo sapiens
  misc_feature 213, 286, 361: n = A,T,C or G
aagctagaggggggaaaaatctcaattccgctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggnggagctcacctatttggaatatggggcatttgttttttccactgcaatgatttcagtctggtttcatcatgtnggaattcgatcacaccattttcaaacaatgttaacatagtccagcttttgtttttctcatctcttctgagagganactcactgtttctgtctgaggaagctcataccctcggcaaaacatcag

SEQ ID NO: 42400 - DNA, 471 bp, Homo sapiens
tcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcatttttttaaatttttggggtacaagctgtaacatttcatctttcaaagtgtaacacgctgatttcctcaaatagagatacccctttgagtgataaatttgcaaaat

SEQ ID NO: 42401 - DNA, 258 bp, Homo sapiens
  misc_feature 256: n = A,T,C or G
gaggttgagctggtaggatcacaataggcccgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcantt

SEQ ID NO: 42402 - DNA, 212 bp, Homo sapiens
gtaggagtttgagagcagcctggctaacatggcgaaaccccatctctactaaaaatacaaaaattagctaggcacaatggctggcgcctgtaatcccagctacttgggaggctgaggcaggagaatttcttgaacccaggaggcagaggttgcagtgagctgagatcgtgccttgcactccagctggggcgacaagagcaagactccgtctc

SEQ ID NO: 42403 - DNA, 473 bp, Homo sapiens
agaatatggactacagaattatagaatacttagggatgggaattgggaggtttgtaggaggcgtgcacgtcagaaggtgggagccatgcagaaaggtcacaggtcttatctaggtagtttcaaggagcaaatgcttgttttgcagtagtggtggcagggtggtttggctcattcaagccccttgctctggaggaacaccgataaaccatcaggatgtcttttcgtcttgcgttaactgtggcaaggctgtgcattaaagaacataaccatcactaaaagggtgggaacaccccagcgaccagtggccagtggccaggtgctttatggtaacaccacagacatgcctggccaatcagatgtgatcttttgctggcacttgctcctttggcccccactgcagtaaacactttcccttggatgttggttttctgttgtgtctggcagccacacagggctgcttgaactttagccag

SEQ ID NO: 42404 - DNA, 470 bp, Homo sapiens
atttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggcccagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattg

SEQ ID NO: 42405 - DNA, 473 bp, Homo sapiens
gattgcagaaactggccttccatctctctcagacaccaagctgcagatccaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagctttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcaca

SEQ ID NO: 42406 - DNA, 467 bp, Homo sapiens
  misc_feature 379: n = A,T,C or G
agcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacccgacacagattgatgtcaatgtccaggatcatttctgggatgggaagggatgtgganatgattctggtactgcaacttcagcgaattgctctgctgcccaaaagacgttttctttggaccaaagatctctttcgtgattccttgc

SEQ ID NO: 42407 - DNA, 336 bp, Homo sapiens
  misc_feature 3, 5, 6, 10, 13, 74, 87: n = A,T,C or G
agnannaaancgncgaaaccaaataattaaagacactgcttattacaattttactgggtctctattttaccctnctacaagcctaanagtacttcgagtctcccttcaccatttccgacggcatctacggctcaacattttttgtagccacaggcttccacggacttcacgtcattattggctcaacttttcctcactatctgcttcatccgccaactaatatttcactttacatccaaacatcactttggcttcgaagccgccgcctgatactggcattttgtagatgtggtttgactatttctgtatgtctccacctattgatgagggtcttac

SEQ ID NO: 42408 - DNA, 473 bp, Homo sapiens
atagaaccacctctggccctcttgacctgtctagcattctttctttctgacctataggatgactctaattcagtctaaatcggctgccctcagattcttgagaacttaaaattgagcagaaattcccaaggccaacctagctctcagggaccaacctgcagaactcaagattgagcgaaatgtttaggccagttgagttttgcaaaatgagtggtaagggaaaacagatctagcctgttatttaaaaccagggttcaaaagccctattgggagaggtagtattgtcctagcatttaaattctcatgaaatgtgcttggtctgtgatctcttggtcagatatctgccttccaggcgatcctttgaggttgtgtaattcagctggccctggctcctggtccctgttactgagctgggcagtcgaaccgaagggcagatgagctcaagatcatgccttgggaagcatggtgctcta

SEQ ID NO: 42409 - DNA, 229 bp, Homo sapiens
  misc_feature 180: n = A,T,C or G
cacattttaaaaataataggtgggtcaggagttcgagaccagcctggccaacatggtgaaaccccatctctactaaaaatatatattaaaaaaaaaaattagccaggtgcctataatcccggaggctgaggcgggagaatcgcttgaacccagtgggggcggaggttgcagtgagctganatcgcgccattgcactccagcctaggcaacaagagcaaaactccgtcct

SEQ ID NO: 42410 - DNA, 452 bp, Homo sapiens
aacataatttttatttttggcaagccgaaaaagatctttcttttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatag

SEQ ID NO: 42411 - DNA, 142 bp, Homo sapiens
cccagaacagatacaggtaagagaaggcaatatgagctgggcacagttgcttgtggcacctacttaagaggtggaggtgggaggatcccctgaggccaggagttcaagactagcctgggcaatacagtgagacctcatctct

SEQ ID NO: 42412 - DNA, 457 bp, Homo sapiens
attgtttctccgttagaaagaaataactgtgccttctccccgctaacgtgtcttatggcaaactttttagttagtaatctgaatctctttttcctttgtatacttagaataggttttattatcagtatgtagaaagtaaaaatgttgatccagtgccacatataggcttataataaaggattctaaccaggcccagttgtgtgtgcctttagtcccagctaccttcggaaggctgaggtgagggaatcacttgagccaggtgttcaagtctagtctgagcaatatagcaagaccttgtctctaaaacaaaataaataaataaataaataaaggactcatcacttattagctatgagacctagtaaaatcacttaaccctggggcctacatttcctcatctataaaacaagattaatggtatcaatctgataggggttgtgagaattaaataatatat

SEQ ID NO: 42413 - DNA, 218 bp, Homo sapiens
gtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggag

SEQ ID NO: 42414 - DNA, 168 bp, Homo sapiens
tacctttctgtaagccatgttattttgaaaaattatcattaatgagcccagattaattgctctctgattaatttacatttatcacgtttacttatgttgtacaatagctcccccctcatccaaggcttcactttctgaggtttcagttaagtgtggtcaagctgctct

SEQ ID NO: 42415 - DNA, 473 bp, Homo sapiens
  misc_feature 8: n = A,T,C or G
aataatcngatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcat

SEQ ID NO: 42416 - DNA, 331 bp, Homo sapiens
  misc_feature 4, 25, 29, 39, 47: n = A,T,C or G
gagnggcgcttgcggccatataatntttntcactggggngaccgtgnggctctgctgtgagtgcaggtcgtgactccttagagtttagtgcctgagcgtcgggggacagggcagcatccttaggtgcagtgctttcaggaaatgtgcatccatggaagtaggaaatgcgtgtttatgttgcccaacctaaaacatcacacttaatggggtgaatttattaggaaccacagccagactcagcagcacagacattttgaaatgctcctaggctgggctgtaggattgcgttttaagtacaggtatatattttttaaacacaactatgttgaag

SEQ ID NO: 42417 - DNA, 369 bp, Homo sapiens
agccagtgaattatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttg

SEQ ID NO: 42418 - DNA, 438 bp, Homo sapiens
cgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgtcgtaaagtgccatcagacaagatcagttgatcagaacaga

SEQ ID NO: 42419 - DNA, 422 bp, Homo sapiens
ctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactcc

SEQ ID NO: 42420 - DNA, 277 bp, Homo sapiens
  misc_feature 3: n = A,T,C or G
gtnactcctttggaattatttgcaaaagcacttattgttaacacattcttagctcatgagttgaatttgaggcataagtacaggtacgtattgctatgtattttttgttctgtaggtacatatttttatttgacatgttggtaaaattttaaattgtagtttgaaatattaaactgagataatagtaaatgcataatgtaatgaattgtgaaggtatatttgtatactacaccaaaatggaagctgtttttaaatatatatatacaattttcttcat

SEQ ID NO: 42421 - DNA, 261 bp, Homo sapiens
gtatgctttgaagcaccttccctgggaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattac

SEQ ID NO: 42422 - DNA, 473 bp, Homo sapiens
actccatcttcttttgctccgtcccacacacacactctatgaagaaattttccaacctgaattttgcccactgatgaatagaattggcagcccacaaggcagctgtgctggcttaaaggacccagtagcatttggctgcattattctctgtcctgacctttgcagccagcacctccccatttctgggagaatatcccacagtcacttctcgctggcgtgcacctccaggaaatacaccttctgaaatgtgggtttctggcattggtatggagatagcatcgctgcctagcccaatagcaaaagatagactcgggcactgggaatttaccggctgctttaggcctaatacctcgtcaagttgcaccatttgataaaatcagaggaattaattaaaaaccatattagaaaccttcatataattgctgatttcctgcttatgctctaagcacatgccaaggtagcaaaatgtacag

SEQ ID NO: 42423 - DNA, 171 bp, Homo sapiens
agggttgggggagtttggtattgaattagtgatacatgcagagtgaccacacaaatatctgtggatgagattgtattcttttggtaattgagcaacatcttaatgacatgatagggacagaggtttcagaagattgcttgataatcctgttgtgttttttttttttttttt

SEQ ID NO: 42424 - DNA, 359 bp, Homo sapiens
gtgattacaggagagttttattttattctctttgcttatctgcatttattatattgagcatgttttcatgcataataagataatcagtaaaaggtattaaaatatacttctgttctatttcatgttgtgaaagttaaatgtcgtaccatttttcctcttagattgtaattatccttctatattcatccaactgttttgatccatgaattggtttagttggaagtaattagaaattctcactcaggtcagaaaagacaaagctgtaaagagctgtgttagttcataactcttgccccacctagaagatacaatttcagtttgctaacagatgagatgataaatggaatatagatttcaag

SEQ ID NO: 42425 - DNA, 451 bp, Homo sapiens
  misc_feature 24: n = A,T,C or G
gagaaatatctgacatctattgtnttccattgctatttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgcttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccaga

SEQ ID NO: 42426 - DNA, 469 bp, Homo sapiens
tactttatttatatttattactgtcctgtcactatagtatgtacttactatactatataagtgacatggacataatgcatataaatatctgatcacttctatgaatttatattttagaaatactttaagtggacagggtttgattttcattttagtagctctgatattggtctttctcttcccattcaagagttttattttgttcatctcaaataatagaagttaatatcatggagcagacagaaataaatttacatattagtatcacagtactcactgaaatcatatataattaacaaaaaatgtttactatccaaacatgatttcactgaattctctattataagccttaagtaagttacatggcattgatatttcagttttcttttcctctgtctttacaccttctcttgggaatctcacccaactaaagatatgtctgcacatggccaggcgcagtggctcatgc

SEQ ID NO: 42427 - DNA, 435 bp, Homo sapiens
gctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctct

SEQ ID NO: 42428 - DNA, 416 bp, Homo sapiens
aaatgcttgaggtggtggataccccatttaccttgatatgattattacacattgtagtcctgtatcaaaatatcttatgtaccccataaatataaatacctactatatacccacagagattaaaagttaaaactttttgaaaaaaaggagagcgggacacaggcacagggagaagatcacgtgaagataccagaagaagatggccaactacaagccgacaataattaccgtcagaagaaattaaacctgtcaacactcgatcttggacttctacaaagtcacttttgccaaatgaagtaacattcacaggttttgggaattaggacatgaacatatcttttgagaggctaccattcagcccactacagctgtttgtaaaaagaagcaagcttcctgatggaagtaaacgttacctt

SEQ ID NO: 42429 - DNA, 468 bp, Homo sapiens
acagtaggaccatgcactcacacccatctggagagggagcccccggtataccaagggagccagttgtgttcagacacacacctcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttccttt

SEQ ID NO: 42430 - DNA, 214 bp, Homo sapiens
atgtttaaaacatttaaggatcagcctggtcaacatggcaaaaccccatctctactaaaaatacagaattagctgggtgtggtggcaggtgcctgttgtcccagctacatgggaggctgaggcaggaggtcacttgaacctgggaggcagaggttgcagtgagccaagattgtgccactgcactccagcctgggcaacagagtgagactgcctc

SEQ ID NO: 42431 - DNA, 313 bp, Homo sapiens
atctgaaaaagaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaagt

SEQ ID NO: 42432 - DNA, 128 bp, Homo sapiens
gatatttggctttctaaatatgatactctggggaggaaatgcttggtttgtgtacaaggagaccagcctacacagtccatcaaatacatctgcccctcatagccaaggaggtattccacctcctaccg

SEQ ID NO: 42433 - DNA, 166 bp, Homo sapiens
  misc_feature 164: n = A,T,C or G
actgtgggctcagaaaccgtgagagtagcccccaccgtggacaccggctctagggccacaggaaaaggaacgtttccaggcattttgtctccagggctcccgctggacaggcacgtactgccctggggagtaaatgcggagagttcacgaactgtgccaccctntt

SEQ ID NO: 42434 - DNA, 258 bp, Homo sapiens
tacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcgac

SEQ ID NO: 42435 - DNA, 200 bp, Homo sapiens
gaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcg

SEQ ID NO: 42436 - DNA, 268 bp, Homo sapiens
atagcaagacctcgtctctactaaaaatcaaataaatgagctgggcgtggtggcgcgtgcctgtggtcacagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttat

SEQ ID NO: 42437 - DNA, 379 bp, Homo sapiens
gctttttttctccgcctcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttt

SEQ ID NO: 42438 - DNA, 470 bp, Homo sapiens
  misc_feature 7: n = A,T,C or G
acatganataaatatgaaggccctatcaccctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttca

SEQ ID NO: 42439 - DNA, 334 bp, Homo sapiens
atcccacctgacatgtccttctgagcccggtaagagcaaaagaatggcagaaaagtagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaagtatacttttacaagtaacaaaaataaaaactcttataaatttctatttca

SEQ ID NO: 42440 - DNA, 471 bp, Homo sapiens
  misc_feature 16, 385: n = A,T,C or G
gatatttgacactagnaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgngtcattgtttacatctgtaactttttcctcccctgttctcattacaccattctggcgaaaatgtaggcaaagtagcttccagtttt

SEQ ID NO: 42441 - DNA, 441 bp, Homo sapiens
gtccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatga

SEQ ID NO: 42442 - DNA, 468 bp, Homo sapiens
cattcatctgtggcatgccctttctgtaatcggctcaactggcagcgcataaatacttgggaagaaaaacaagcaattattgtttaaaaagagaacacgataattagtcatgcaagtaaattttcctggtgttcagtcttccctatggtgttaaatgcttttcattaaaggagttttcagtaacatcacaaattcaatatttagttgtttatttactgagtgtctacggtgcactaaactctgataggtagagagtacagagatgattgagatgtgttctttgagttgcatagaggtcagtttagtcaagaaggcaagaaatcaattatgtttcagcactggtaagtgctgttaacagtggtgaatgctattcgagtacagagaaataatatctaattcagcctgtggaggtgaaaactccactttaaacaggtaacccttgagcggacgagatctagaggtgtagct

SEQ ID NO: 42443 - DNA, 190 bp, Homo sapiens
aagattaaagcaaatagttccatagacacagcatagtacaaatgctgaaacccaaagacaaggaaaatatcctgaaagcagcaagagaaaatgaattttcacttacaagagaacctcaataagataaactgctgacttcttatcagaaataatgatgaccagaagacagtggtgtggtgtattcctagtg

SEQ ID NO: 42444 - DNA, 170 bp, Homo sapiens
ctggtccaagtgcagctgctgcgcctgatgctgggacagccccgctcccagatgtaaagaacgcgacttccacaaacctggattttttatgtacaaccctgaccctgaccgtttgctatattcctttttctatgaaataatgtgaatgataataaaacagctttgacttg

SEQ ID NO: 42445 - DNA, 471 bp, Homo sapiens
  misc_feature 17, 255: n = A,T,C or G
cagacatttctggaatnaacataagcgtctatcaacagatgaatggataaagaaaatgtggtatatatatatataacggaaaattattcatccttaaaaaagaatgcaattttgtcacttgcagcaacatggatggaacaggagatcattatgttaagtgaaataagccaggcacaaaaagacaaatatcacatgttctcatttatatttgggaggtcaaaaagagggtcccatggagatagagagtagaatggnggggccagtcgtggtggctcacacctgtaatcccagccctttgggtggccaaggtgggtggatcacgaggtcaagagatcaagaccatcccggccaacctggtgaaacctcatctctactaaaaatacaaaaattagctgggcgtggtagcgcgtacctgtagtctcacctacttgggaggctgaggcaggggaatcgcttgaacctgggaggcag

SEQ ID NO: 42446 - DNA, 128 bp, Homo sapiens
cattctggtgaatgctgctgcctaagccctctcttaagctttggggagagatgaatccccctcccctgtgtcatacccaaagacatggcatagacaaattttctgggaggcagtttctcccatgtgtc

SEQ ID NO: 42447 - DNA, 172 bp, Homo sapiens
aattcagtgtggtatttgcatagggataggcatgtagttcaatagaacagaatagagagctcagaaatgtacccacatatacatggttaattgatttttgacaaaagagccaaggtaaatcaatgagaaaaggacagtcttttcaataaatggtgctggaaaacctggatat

SEQ ID NO: 42448 - DNA, 452 bp, Homo sapiens
agtttatgggaacataacaaataaatgtaaagcctcccctaaaatagttaaaattcaagaaattcaacatggtaaaaccccgcctctattaaaaatgcaaagattagccgggtgtgatggcatgcgcctgtggtcccagctactcgggaggttgagacatgagaattgcttgaacctgggaggcgaaggttgcagtaagccaagatagtgccactgcactccagcctgggtgacagcaaggcgccatctcaaaaaaatgaaaacaatagaatacaattgtgggagactttaatacatcttgaaaattaaactggtttatcagttaaataggaataatgaattttaactgtaaaataaataagacttgattcattttcatagaaatgtatgtatttggccatcttttataataatggaaaaattaataaaaagagctatcattaaagcaagac

SEQ ID NO: 42449 - DNA, 338 bp, Homo sapiens
  misc_feature 31: n = A,T,C or G
tggctagtggtgacaaatgtcttctttaatnggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagga

SEQ ID NO: 42450 - DNA, 468 bp, Homo sapiens
atttccgaagataagatgtacttgtacatgatttccttggataaacaaaaggagagaggaagtagccaagaaaattttgaagaggaggacaaatttgggcatgacttgctctaaaatatcatgacttattataaagctaaaagatttagacagagtggagttggcacctgagttaatcttatgggccagagtagggaagaattgagagtccagaaatagttaaattcatatatgaatgcaagatgtgtggcaatggtggcattaaaagccggtgggggaaagtatgggttgctcagtacatggtggtaggacaattggttatccatatgggaaaaagtaaaattagaccctggtgacagaataaatcccaggtggctcaaaaaccttaaactgaaaagcaaaactttaaaaatcttactgtcaaaaataggagtatttttatgacctcaggttaaggaaggatttcat

SEQ ID NO: 42451 - DNA, 287 bp, Homo sapiens
agtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatattt

SEQ ID NO: 42452 - DNA, 382 bp, Homo sapiens
attgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatatta

SEQ ID NO: 42453 - DNA, 469 bp, Homo sapiens
  misc_feature 25: n = A,T,C or G
ctgtgctgcagcaggctctccaganctcagcccaagaagagcttattgggatatttaggggtaaattccagacccctaagcaaatttcactttctgagatggttgtgtaaagaaacaaaaagaggcctgggaatacagtaattgaatgtgaggaagaaaaataatcctcccaaatattttttccagtactcaacaggctgctccctcctgctctgggcatcttcctcttctcttggcaacagctgggagggaggagacttgcttttgagacttgcttttaatggagagttggcttccctctgattccactgtttggatttcttgaactaatgagaggtgccaatcaaagttatgtttcccctgtttagttagctcatttcacttctttatgccatttaataatggtgaaatcggtcatctatgaaagcactgtggagttggcctgtgtaatcgcatgttctttgttcag

SEQ ID NO: 42454 - DNA, 289 bp, Homo sapiens
gcggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacattccttgtccgtcgaatttgaaggcg

SEQ ID NO: 42455 - DNA, 469 bp, Homo sapiens
  misc_feature 141, 165, 168, 215, 220, 247, 261, 292, 462: n = A,T,C or G
atgaattcagtagagtttcgggatgcaggatcagtgtacacaggttagtggcactgctgtacaccaacagtgaccaagctgagaatcgaatcgggagctcgatccccttcacaacggctacaaaaaaaaaataaataaatncttaggaatatactgaaccaaggnggngaaggatctccacaaggaaaactacaaaacactgctgaaagagagtntcagngacacaaacaaatggtcatggatgtgnggaatcaatgctgngaaaattaccgtactgccaaaagcaatctanagattcactgcaattcccatcaaagtaccatgatcattcttcacagaactaaaaaaagtcctaaaattcatatggaactaaaaaagagcctgcatagccaaagcaagactaagcaaaaagaacaaatctggagcatcacattacctgtcttcaaactatactgcaaggcngtagtta

SEQ ID NO: 42456 - DNA, 470 bp, Homo sapiens
  misc_feature 36: n = A,T,C or G
atagaaagatgatgagctattttaatccttctagtnactttgtaaacaaaattagaaggctttgtattcatgaattaataataacatgagaacggtggtgactacgcattgcttacaaagctattcacattcattttcatataatagaaaaatcaaccttaggtcagcccgatcgagcataatatgcagggttttctcttttaaaatatggcaacaataaattgaaactgaaaaccatttaacacaatatgttaaattgttttctatattaggtttggataaactggcatgcttaattgcttctttctgttttacataataatctattttcttcaccagagtaaaatatattttaatggtgtgaaaaattactcttatgtcaacaatcttattaccaaaactatgatttgttctgatttaacactagcaattaatgcttgcaccattaatttacagcctacagcactagt

SEQ ID NO: 42457 - DNA, 258 bp, Homo sapiens
  misc_feature 33: n = A,T,C or G
agcttttgtattatcaagtaagattctattttngttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctata

SEQ ID NO: 42458 - DNA, 468 bp, Homo sapiens
gagggggagtcgcagagtttggaagatctctctaacacctctcggccaacttcagaagtgtataagatcagctttatctttccaaatggagacaagtatgatggtgattgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaataggggaagtcaagcctctctactgcttctttttataacctttaagttaattcagaacccagataagccttgatctgaggatgatataaccaccgcaggcaacatgggaacttctagagaaaacaag

SEQ ID NO: 42459 - DNA, 413 bp, Homo sapiens
gacttccggttgctaacggttcccaaacagcccccgaaaacgctacgtgagctgggccctgggccagaggcagaaaacggacggaagaaaaggtctggccggagatgggtctcactctgtcacccagactggagtgcagtgagtggtgcgatcatagctcactgcagcctgaaactcctgggctcaagtgatcttctcgcctcggcctcctgagtagctggagctacaggtgtgagctacccagcatggctcatttgagatttctgagtagagaagtaacatgattaaacttgggtattgagattattattttggctgctatgttaacagtagacttgaatgtgaaggggttgggcaagggcagaagcagggagacaggttggaaagttggagtgggaagggcctttttaaga

SEQ ID NO: 42460 - DNA, 470 bp, Homo sapiens
  misc_feature 8, 33, 59: n = A,T,C or G
ctgctacnaagagacatgtttttttaggaggtngcctgaatcactatgctaggaagtanctcctttgtcacactgttcagagtagttgactcctgttcctcagccattactaagacttgttaaagataatcaagtgtcccgtgattttggtataaagaaacagaattttagaaattattttttacatattctttttcttcaggcaagatgacacaaattatttttggaaaaatggtttcaaggggcatttgttattactgtttttccattttatttatttatttaatagactttgtattttagagcagtcttaggttcagaacaaaattgagcagaaagtacagagtgcccccactatttacatcctacgccacagtggtgtatttgttacaatcgatgaacctacatcaatgtctcattatcacccaaagtccacagtttacactctcagtgttgtacattctgtggat

SEQ ID NO: 42461 - DNA, 467 bp, Homo sapiens
  misc_feature 7, 246: n = A,T,C or G
caccgtntatactatttatagtctcagctactagggaggctgaggcaagaggcttgagaccaggagctcgaggctgtaatgtgccatgatgattgcacctgcgaatagccactgcactccagcctgggctataatatagcaagaccccatcctttaaaaaattttagaacttttttaaaatcaaagtgcagattgcttgtatgtaaaacccaaataaaggtagagtaagtgtgatatatgggagtnttaaaatagcttaaaatttctcgtgaaggacatgtggctaaagggtcaaaaaggatgtaagacttggagccggagcatagtatttcctgaaataacaagtttagtgctttaactatggctacatgtgcttaaggaattttgagccacttatttttgaagatgctgaggacatgtagagtgctttttgtagtgagctaaccttgatctctaaggactaacta

SEQ ID NO: 42462 - DNA, 357 bp, Homo sapiens
  misc_feature 1, 15, 16, 33, 49, 52, 82: n = A,T,C or G
nctctggaattttgnnataccatacctgaatanaactaaaaacacatanggnctatgttacaactactacagctctgctatnatagcacaaaaagaaagccagataatatattaatattaaaacaaaatgggcatggctatatccaataaagcttcatttacaaaaatagccagcctatggaccacatttgactaagttcaaacagaaataatcctctttaacaagaaataaaacaataccatttaaaggaagataacataagccagatgccttacaaggtattattcacaatgcctaccattcaattaaaaaattactagccatacaaagaggcaggaaaatctgacccataatca

SEQ ID NO: 42463 - DNA, 469 bp, Homo sapiens
gcaatatagtagaaggaatctcaattacaaaatctaggatcaaattttgactctacttctgtgtgaccttggggcaagtcacttgatctctgagtcttacttttcccatttgccaaataaggcttataaaaagcctaccctgcctacttttaggggttgttattaaaaaccaaagcactttgtaaatggtaacacacaatgtaagtgtaaatggttttctttgtaattatactacagaattaacattagtataataaagaactttgtccatatccacattaagattttgagtgaagctataatatacatatttatgaaactgaaactcaagcatattttctattactggcaaatatctgtcagacagaacgtctctacttaacaagaactaagtcatcagtaactaattgtcaatacagtaaggtggctatgattcaagcaagcacttaacagatgtatgagtcacaat

SEQ ID NO: 42464 - DNA, 403 bp, Homo sapiens
agtataaaaaataaaatatgtattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttgggtgaagttcactgtattgctatatttttgtaga

SEQ ID NO: 42465 - DNA, 466 bp, Homo sapiens
tgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtat

SEQ ID NO: 42466 - DNA, 460 bp, Homo sapiens
  misc_feature 7: n = A,T,C or G
gctgtgnttcaacttggttttttgtgttctcgggagaagacacccttggccgtgggccgtgagacctttgatgtgtgtttacgctgaccgcgagttgttgggatggtttctgcggtgggtggttctcttggtattctcggttttgaagcttatttttagactctgaactctccttcttggcaggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacaggtacatggcttctgggtgtctgtccccgctgtacccagatctgcccccttgcccttgtccccagatcctccactcgctcctaggaaccgtacccct

SEQ ID NO: 42467 - DNA, 471 bp, Homo sapiens
  misc_feature 7: n = A,T,C or G
agtgcantgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagctt

SEQ ID NO: 42468 - DNA, 393 bp, Homo sapiens
agccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagactttca

SEQ ID NO: 42469 - DNA, 433 bp, Homo sapiens
  misc_feature 417: n = A,T,C or G
gacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgngttatgaaaatataga

SEQ ID NO: 42470 - DNA, 220 bp, Homo sapiens
  misc_feature 23, 151: n = A,T,C or G
gaatattgagaagaaacttaatngaatagcaggtcagaggctcctaactgggcaactcaagattctggcttctactgaagaaccataaagaaaagatgaaaaaaaaaactatcaaagaaagatgaaataataaaactattatataaagggngaccttacattttggaaacaacatattacgtataaattttgaagaattggaataaaattgattcatttc

SEQ ID NO: 42471 - DNA, 444 bp, Homo sapiens
atctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaaga

SEQ ID NO: 42472 - DNA, 366 bp, Homo sapiens
aaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatg

SEQ ID NO: 42473 - DNA, 318 bp, Homo sapiens
agaatacagagtcctaaaatgtgtcatccactatggtcagtgtaaactaaaaaaattctggcaggaaaatgaaacataaacaagagaaaaaggagtcaataaaaatagaccctaagaagacacagctgtgggaatagcaaatgctttaaaacagctactattaatttgttagaggaactaaggattttgtcataaggagtgaacaaatggaaaatctcaaatgagtaatgaaaagtttacaaaagggccagatagaaactctggaattgaaaagtaaaatatctaaaatagaaaattttgcaatatgggcctgacagc

SEQ ID NO: 42474 - DNA, 124 bp, Homo sapiens
atttctaaatacatttgggcatgtgtattagggcctatatgttttctctgagaataaggacacacagcctagtgagttttggactcgaatcctattatatgtgaattttctttctttctttctt

SEQ ID NO: 42475 - DNA, 165 bp, Homo sapiens
  misc_feature 4, 12, 44, 75, 128, 132, 141: n = A,T,C or G
agantccggctntttgatgggccggggcggactccttgaacggngggagcactgcgggctgcgtgcgtgcgatgnaagaacgcagctagctgcgagtaattaatgtgaattgcagggacacattgatnatgngacacttgngaacgcacttgcggccccgggttc

SEQ ID NO: 42476 - DNA, 315 bp, Homo sapiens
  misc_feature 24: n = A,T,C or G
aggagaaactgggcctgacccggnattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttt

SEQ ID NO: 42477 - DNA, 326 bp, Homo sapiens
gtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcaccacccatgtaaacatgctcatgaagttgaaagtaattaagatttgatacactgatatcaatttatttatgtaactaaatcactgttttataaacttgttaatgatcaacaatttttgttttgattaaaattagttttttgaaagttg

SEQ ID NO: 42478 - DNA, 387 bp, Homo sapiens
atggattagtgaaaagtctcatatattgttggtggaactgtaaactagtagcaaccacactgacagacagtttgacagtttcttaaagagttagttgtacacctcccataccgtacataattctatatattcctaggcatttactcaagagaaattaaaaatatacatctacacaaagacttgaacacaagtattcaaagcagctttattcctaaaagtacaaaactgtacacagcccagatgtctgtacccagaagagtggaaaataaatgatggtatatccatatagtgggatagtactcagaacaaaatatatgtagaatcatgaatgagtgtcaaaaaatatgctgagtgaaaaaaattggacccaaaaaacatatacacatg

SEQ ID NO: 42479 - DNA, 467 bp, Homo sapiens
  misc_feature 10: n = A,T,C or G
gactcccganctctactgactcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagcccagtggaactgagagagcccaacgtcctcatctgtttcatcgacaagttcaccccaccagt

SEQ ID NO: 42480 - DNA, 275 bp, Homo sapiens
caaatggcttgcttgagcccaggagtttgagatcattctgggaaacatggtgaaaccccatctctacaaaatatataaaaattagttggcatggtggcatgtacctgcagtctcagctactcaggaggctgaggtggcaggacggcttgagcccaggaggtggaggttatagtgagctgagattgcaccactacactctagcctgggcaatagagccagatcttgtctcaaaaaacaaacaaacaaaaactccccaaaaaccataaaaacaaaac

SEQ ID NO: 42481 - DNA, 314 bp, Homo sapiens
gacacagtgttttcttgaaataataatgcttataaaagtcttaactctaggagccattgaaaagagagctgtatccaatgtcccctgagtctgtcacgctggcccagccacggacagctggcttcttggtgaagaagggcaaacaggcatcgtagggtggtgtctgaaaaggagagggtttccttcaccctgatcttttgcttacccacctttaagaaaatgtgagtttttactttgggaggccaaggtgggagaatctcttgggcccaggaattcaagactagcctgggcaatatagtgacaccttgtctcta

SEQ ID NO: 42482 - DNA, 142 bp, Homo sapiens
cttgaagcatcagggcgtgaaatcaaactagatgtgggcagggagagggttgcttacctgccctgctggggcagggtttcctgaaactgggttaattctttatagaaatgtgaacactgaatttattttaaaaaataataac

SEQ ID NO: 42483 - DNA, 339 bp, Homo sapiens
  misc_feature 13, 19, 32: n = A,T,C or G
cacccagggaaantcggcnttatggccggatnaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcctt

SEQ ID NO: 42484 - DNA, 468 bp, Homo sapiens
  misc_feature 25: n = A,T,C or G
caggagaagctccaccagctccagnatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatca

SEQ ID NO: 42485 - DNA, 419 bp, Homo sapiens
  misc_feature 8, 13: n = A,T,C or G
aaggacgncaagnaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtgggagatgctccagctgctggtgaagatgcatgaataggtccaaccagctgtacatttggaaaaataaaactttattaaact

SEQ ID NO: 42486 - DNA, 470 bp, Homo sapiens
  misc_feature 21: n = A,T,C or G
aaggaaaacgacgtcataatngcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttag

SEQ ID NO: 42487 - DNA, 107 bp, Homo sapiens
atgtctgcactgagaaaactgcatttcagtagcatttgtcatccagccggaagttaaagcacacttattttattcacctatttttataataaacgttcttgctgctg

SEQ ID NO: 42488 - DNA, 195 bp, Homo sapiens
taactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccc

SEQ ID NO: 42489 - DNA, 192 bp, Homo sapiens
  misc_feature 191, 192: n = A,T,C or G
cgtttctctgcagaagacagcaagcatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgcnn

SEQ ID NO: 42490 - DNA, 464 bp, Homo sapiens
ggagaagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagc

SEQ ID NO: 42491 - DNA, 164 bp, Homo sapiens
  misc_feature 5: n = A,T,C or G
caatnatatagttgtgggtttttctctagacatatcaagctcttcaggtacttagcatggagtgaacagacaggtaggtttaactgggatggatgtttagcttggcaagtatgatgcagcgagcatggtcaagggaacgattataatggtatcccatggaaact

SEQ ID NO: 42492 - DNA, 349 bp, Homo sapiens
cttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattg

SEQ ID NO: 42493 - DNA, 382 bp, Homo sapiens
actggggttagaaatttgtcattcaacaaacaaatgaagtgtaacaagaactaggatttttttttccctctagcagcttagtgagaaagaggtaggagagagtttatgtagaaaactaaataagataaaagtactttgtgtaatagaaggaatttgtattttgtctttttggcagaggggagtcgtaaagttttagagattggagagacataatgtttatgtttggagttgaggtaaggagctagttagagggaatggttgtatataggagaggtagcgagcaaggttcctgctatggaggaggtgggtgtgtctgcgattgagagtccatggagggagtagccttgagcagaaggcatactttttcctttgaaacttgagc

SEQ ID NO: 42494 - DNA, 448 bp, Homo sapiens
gatatcaaaggctgggctggatttgtcttgctgtatgtgtcaggaaatttatacctattacattttccattttctcaaaataagtcacatgattgtaatgtttagctgcaacttttctcctaataaatagtgtcatgaagaatgttatagtgcgaagtttgtacatttcagggtcagttatacaatgtgaactctttatctacgggaatgagaatggaggatcattgaaggccatgatataaacaaatttgcatgttgaagcctgtataaaacatggtacagtgagtgaatgcccccatccccaagaacactttatacatattaaatggatatatgattactgtgcaaaaattcattctggaaatgaacatatatttgagcactaatatgtaatgtacatcttctgccctaaggagaaaataaatcataaaacttgttttacattcga

SEQ ID NO: 42495 - DNA, 454 bp, Homo sapiens
  misc_feature 33: n = A,T,C or G
ccggtctgcttcttgtaaaaacctgaacccagnaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcgaaataaaatctcggtgttctatttatttattgtcttcctgtaagaccttcgggtcaaggcagaggcaggaaactagctggtgtgagccaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattatttg

SEQ ID NO: 42496 - DNA, 464 bp, Homo sapiens
  misc_feature 389: n = A,T,C or G
cattcagacctggtgcaaattagaaagtggtttttgccaactcaattcagctttgagccatttcctgattacatttgctcattcaatgtagctatattaattgtagagggcaatgccatgcccttagagactgttttgactgtagacagcatttgcaagatgcaagttcagcagacagcgttcagacagtggcaagaaagtcgtgcaggggagctggtgcctgttgagtgccaaagtagcaccagacccaagtctgactttcaggctgtatttaataaacccctcagagagggagtgtttctccttcagccttttcccatttcagctagtgttacaaatcccaaatgtgagtctatgaccagcaaagcaatcaaagagaatcagtagtnggacactaaaattcaagcagtctagccgtgcaggccactgctataaacaagaattaaatgctttccttcagcgag

SEQ ID NO: 42497 - DNA, 467 bp, Homo sapiens
  misc_feature 7: n = A,T,C or G
gacagtnaacaaagccgcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatatagattaaaagcctttcttacatcttgaaaattttctaatatttgagaatttcacagggatgttttttatattggacccttttgactttccagtcctgtgactttctacttttagtagagagtcagaatctctggactggagaataatgaaagaagttcactgactgtgcactgtgcttagagaccctgccgcaccacagtgccaatgcttgtcagacacatgcccttcggcagcattccagaacaggagggaagagaaagagaaaactttctt

SEQ ID NO: 42498 - DNA, 140 bp, Homo sapiens
aacacaatggggctcactcacccaccacattaacaacataaaaccctcattcacacgagaaaacaccctcatgttcatacacctatcccccattctcctcctatccctcaaccccgacatcattaccgggttttcctcct

SEQ ID NO: 42499 - DNA, 324 bp, Homo sapiens
tatgatagaaaaaatacaaatatgaatggactaactctccaggtgagagattgccagatgtggtataaaacaagctagcactcttagacattcctaaaacataagactatacaaagaatgaaagtgaaaggaaaaaaataggtgtatacaaatcaaagctggcgtattagctatattactatcagaaaaagaagagtataagacgaaaagcatcattaagaatgagagggtgtctctcagtgataattggttccgttcacgaagaagatacaattattataaatattcaagcatctaatacaataatctcaatatatataaagc

SEQ ID NO: 42500 - DNA, 472 bp, Homo sapiens
gtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcatttagaagtcattagttgaccacagaca

SEQ ID NO: 42501 - DNA, 383 bp, Homo sapiens
gtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatgcttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatg

SEQ ID NO: 42502 - DNA, 401 bp, Homo sapiens
  misc_feature 8: n = A,T,C or G
ataaaccnttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgctttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgaga

SEQ ID NO: 42503 - DNA, 187 bp, Homo sapiens
  misc_feature 7: n = A,T,C or G
gaagtcntccaaaggagagattcttcagattgtaaatagagaagatccaaattggtggcaggctagtcatgtaaaagagggaggaagcgctggtctcattccaagccagttcctggaagagaagagaaaggcatttgttagaagagactgggacaattcaggacctttttgtggaactataagtagc

SEQ ID NO: 42504 - DNA, 262 bp, Homo sapiens
  misc_feature 11: n = A,T,C or G
caatcagaacncaacgggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtgtgtggg

SEQ ID NO: 42505 - DNA, 212 bp, Homo sapiens
  misc_feature 12: n = A,T,C or G
gaaggctctagnaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtg

SEQ ID NO: 42506 - DNA, 278 bp, Homo sapiens
gttgcttaaggtcaactaatgctctttggcattttgggactgcccctcacctactgagtccttcacctgtggagccccagcagctggacacccgggtgctcagtcttccactgcgttcactgcgtcttccccttcagtggtcaccctggtgggtggtggtcgcacagcttggtgtgtgtccttaccatgctgtagcctctggtatttattaatgaaaacttttctttgtgcgtgaccatctctgctttgcattcttcccaatgaccaagaacattttg

SEQ ID NO: 42507 - DNA, 390 bp, Homo sapiens
agtacggctcactgcagcctccacttcctggactcaagtgatcttctcacttcagccttctgagtagctgggactacaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtg

SEQ ID NO: 42508 - DNA, 105 bp, Homo sapiens
ctgctggaatggttgttgttttccactgagaaagctaagccctacatttctattcagagtactgtttttagatgtgaaatataagcctgcggccttaactctgcg

SEQ ID NO: 42509 - DNA, 425 bp, Homo sapiens
  misc_feature 7: n = A,T,C or G
cacatcnatgtagaactcagccttcttggaaagaaacaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaattttttggatggtattctat

SEQ ID NO: 42510 - DNA, 462 bp, Homo sapiens
gtctggatgagtatgaagatggagacaaactcagtaatccttccctgttcccatgcttatcactgcaagtgtgtagacccttggctaactaaaaccaaaaaaacctgtccagtgtgcaagcaaaaagttgttccttctcaaggcgattcagactctgacacagacagtagccaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtccgtggtccagttgcagcctaatggtgaacgggattacaacatagcaaatactgtttgactttcagaagatgattggtttacttccctttaaaatgatta

SEQ ID NO: 42511 - DNA, 467 bp, Homo sapiens
  misc_feature 34: n = A,T,C or G
gttcttgaggtaaatatcatagatttgataacantatgtggtaatttatttcacctagaaaaactggctagggaatatacaaccacttccagccattctgtatgcaggtgaatcttggtttccctgtgggcaatgatgtatggaacttacgaacaatatgggcagatcaacaaacagcacataaaggtgagtaaataacattagcctgatatttatgcaaattactgtttttcttatctatttcagcaagattataaataatatactcaaatttttttgtgtattttaacctttatattttagttttcctaatattaattttgatatataaaaatgctatttttaattgattaataaaagaggcaacatacagttgttcatgttaatatttattcttcatatttatacaataaatgttcctaagcattagatgtaaatattacaatgcaaaatagttcttcgggtat

SEQ ID NO: 42512 - DNA, 346 bp, Homo sapiens
gttatgtgtgagaagtagaatccctgtttcgaggtgattaccttaagctggtcaatggaatatatagccgtagatttgatgttttcattttctctgaagagccaacacaagtaagtttaaatattattcttacaatctttccagaaattaaaatgcttcagccatgatacagcagtctttggaattttttaaagggctgagttgaagatgtgattgttctcttaaaaaataaataatattttaggtactcaccagggcttcccacttctaaagataaacactaacaagtagttgttccagcacacaatttgctttcctgtagcatcaagccagttatttgtattgc

SEQ ID NO: 42513 - DNA, 163 bp, Homo sapiens
  misc_feature 163: n = A,T,C or G
atctaaatgagtagcaagaattcacatgggaacttcatttatgtcagtggactgacaatagcagatatgatcactaagctttctgtgaagtaaataacaagtctgctttcactttctgttggataagactttggaatttcagaattttctttccaagatggcn

SEQ ID NO: 42514 - DNA, 465 bp, Homo sapiens
tgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaaagactgttacttcctagtaagccaagtaataccatatttttattaacatctaactcttgtagatgggtgctaaaattgcatacattttaaccactaaaatagaaaaacaagtggtgct

SEQ ID NO: 42515 - DNA, 440 bp, Homo sapiens
  misc_feature 32: n = A,T,C or G
gaaatgcttctcacagataaatatatagctantttacaaagtagaggtgagcagtcccttttccatgtggagatctgatgtgaaatgtttgcagacccagaatattaacaggggcgttgacatcagtaattactatagttacgagacatttttcacaaagtattatgagagcaatacttagttatacagggagaaaaaagcatgggactttttacatcgtgtatgaaatatgtaggtaccgacagtctcagaaaacagtgtgggcacattggtgactgaggtgctttttgcctgtagcataaaatctgtctggaaagttccagcaatttccactgagatagcacatttggcaagatgaggctgagtgtggtatgtaaggactttcgggaaaacttgtcagctttcacagggaaaggtccaagtgtttatgggaactatga

SEQ ID NO: 42516 - DNA, 356 bp, Homo sapiens
  misc_feature 26: n = A,T,C or G
actgcaagggtattgggaatggctcnttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgttttttgttg

SEQ ID NO: 42517 - DNA, 468 bp, Homo sapiens
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtataca

SEQ ID NO: 42518 - DNA, 365 bp, Homo sapiens
  misc_feature 22: n = A,T,C or G
gctttctggtctcggccgcagnaagcgagtatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttcca

SEQ ID NO: 42519 - DNA, 205 bp, Homo sapiens
gttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaagcagtgttttat

SEQ ID NO: 42520 - DNA, 119 bp, Homo sapiens
gtttgtgtgtatgtgtgaagtcagaggtaggagttgaaggatagggaaaacacagaggggttaggaatgcttgggccccatccctgctctgtggcttgtacagtattttgctgtttgcg

SEQ ID NO: 42521 - DNA, 464 bp, Homo sapiens
taatcaaaagtttgatagtactgacttttttaaaacctttcagttacatagccttacatgattactgcgcagtctctacttggttattaatttttagatccttgtgtgcagttggaaagtagcagaaaatttggtatagtcacattcacaaaaatatgtcactatgttagtattacaaaaacatataaatggatcatgaacattaaaatgcatataatataggagttgttaataaaggaaggagatgtatattcattcttctcagcaccacatcacacttattccaaaattgactatatagttggaagtaaagcactcatcagcaaatgtaaaagaacagaaattataacaaactgtctctcagaccacagcgcaatcaaactagaactcaggattaagaaactcactcagaaccactcaactgcctggaaactgaacaacctgctcctgaatagtgactattg

SEQ ID NO: 42522 - DNA, 111 bp, Homo sapiens
cagcctctccccgctctggatcctgcactctaacactcgactctgctgctcatgggaagaacagaattgctcctgcatgcaactaattcaataaaactgtcttgtgagctg

SEQ ID NO: 42523 - DNA, 343 bp, Homo sapiens
agatgaacaaatgttgattttattctgtagaagtgatgggaaatagtagaacaattttgaacatctctttgttaataccttttttattaacttcagaaagtaaagttgaacaaaatttctggtctggtgggattgcataatgtaatgcttcttgagcatgcagtaggagttcagaggaagattattagaacctctgaggtgcctgagattttgatgttaaaagagaggcagatttaaacagtcttaaaatgcagtattttctaaaggtggaaaccactcaggagacaggtcagggcatgaggtggtgagagccggagctggactacatcagtatgtggaggga

SEQ ID NO: 42524 - DNA, 117 bp, Homo sapiens
ctgtatgtagtattttaaaatgagttaaaatagatttaggaatattgaattaattttttaagtgtgtagatgcttttttctttgttgtttaaatataaacagaagtgtaccttttat

SEQ ID NO: 42525 - DNA, 220 bp, Homo sapiens
agtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacatacc

SEQ ID NO: 42526 - DNA, 431 bp, Homo sapiens
gctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttat

SEQ ID NO: 42527 - DNA, 369 bp, Homo sapiens
catcctgctgttctttagatgaggaaactgaggatcaggaaggttgagttactctcctataattatactggtaataagtgggaagcccagactcaccaatgatctctttgtcaccacagcccaccattccttgtcaaagtgggatttgtaaaggcatttgtggggcccgctttataatgaataatactgctgcatggttttggtgccggaatttgtgttttatatttgcaatccagtttgtccaatgctattttagtagctgtgggcttatgggaatgaacaatggacttatgtaatttgcctcaagtgaaggctatatgactgcatggcacactggtccagtatgtttagttttgctgtggataaaga

SEQ ID NO: 42528 - DNA, 475 bp, Homo sapiens
atatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagct

SEQ ID NO: 42529 - DNA, 169 bp, Homo sapiens
aactgtggtaattctagagctaatacatgccgacgggcgctgacccccttcgcgggggggatgcgtgcatttatcagagtcaccaaccccaatgccaggctgcgcagtgaagaaaatgagtaggcagctcatgtgcacgttttctgtttaaataaatgtaaaaactgcc

SEQ ID NO: 42530 - DNA, 466 bp, Homo sapiens
gaaccaaggaataggaaggacaaaccagaaattaatgaaactgattaattacactagttgggcccaggggaaggggatagagagaatgggaatagggagcaagagtgaagaggtgatagggagcgacatttatctgaatggacttttttggtgtagttctgatttttggaactgtgttaatatttcacatactcaaaacgtaaataattgaagtgaattagagtattcagggtaccccacatgaaatattaaaaaatagcaagaaaacttaaccatattcttaggaattacagatgaaggaagtggataaaaaagagctaatctaagtaactgccaaacagtaattggcgtttatactctaaaattttttaaaaatgaacagaaaagaactgttgtactcttatcagaatatttgtatttcacaagatatgggtgagtgattcaattttttacaggggtgagatta

SEQ ID NO: 42531 - DNA, 472 bp, Homo sapiens
  misc_feature 4: n = A,T,C or G
ggangtgccggctcaatagacatcagcgatcacatactggagagaaactctatgggtgcagtgtgtgtgggaaagccttttctcagaaggcatacctcactgcataccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagaccgt

SEQ ID NO: 42532 - DNA, 424 bp, Homo sapiens
  misc_feature 31: n = A,T,C or G
cataacataatttgggaaccattgccaagtntggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagccttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaaga

SEQ ID NO: 42533 - DNA, 471 bp, Homo sapiens
attctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgac

SEQ ID NO: 42534 - DNA, 475 bp, Homo sapiens
cagtcagcagcctggtatgatgtgtcatcaggaagttatgacaaagcacttcgcttcctgggatcaaatgatgaggagatgtcctatgacaataatccttttatcaaaacactgcatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttg

SEQ ID NO: 42535 - DNA, 471 bp, Homo sapiens
cagagtttaaacacgataaatatgctatcttccctatgaagaaaccatcaggtttattgatttttttttaactaaagaagctgattctagaatttgtacagaaaatttaatagtattaggaaaacaacaaagtggtgcccaatgaaatggagatgggaaagaatactgctagatttcaaaattcaatttcatgattgaattaaaatagtatggaagaggtgtggcttcaaaaaccagtggggaaaagctagattgttcgactattcaataaacagcttttggactactaggtagtcttggggacaaggggaggtggacttacaccttacaccctatacaatttctaaccacataaaacatttttaatatgaagaaatgaaaccacaaatgttctggaaaaaaccatgaaatagttccttcataatcttggagtagaaagaggctttctaactatgattcaaaatccagaag

SEQ ID NO: 42536 - DNA, 445 bp, Homo sapiens
ctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttg

SEQ ID NO: 42537 - DNA, 478 bp, Homo sapiens
tagcccgaaggggacgccgggaacaggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcatacctgtattaagctctttattccactgctga

SEQ ID NO: 42538 - DNA, 141 bp, Homo sapiens
atttgtgatcagtgatcattgtccaactgcgaaatagagtgtttgcttttgataatggaaaattgtattcgttttaaaattccgtttgttgagaataacaatatgtttaaaaatataattgaacaaattttaaaaaaaaag

SEQ ID NO: 42539 - DNA, 471 bp, Homo sapiens
gcatccctctacaaaatgtttaatgttttaaacagatttactccctacagtctgcttgggttagtagtttatatagatttaatttagcattttctcaagtactgggctttttttctggcagaatttttcaaatagccaaaacataattttccctctgaatattaaaaaacaccaacaaaaaagatttttacacgacaaataatttttacatatgcaaaaaagtaattttcaaaagtaagcacttctgccagatgatgcttaataagtctgtcctaatggtatttatcttaatgcttactttcaggaacagtggataataccatattcagtccccctgacaaccccctgaaacaggtaatgtcattagtcctactttctggaggaaatgaaggcacagagaagataagtaacttgcctgaggtcgcacagccaatatgcagctgagtaggagttgagtgctaggctgttgga

SEQ ID NO: 42540 - DNA, 394 bp, Homo sapiens
aacttggagaggtgacctgtgtgacctgtcttacttgctgtatgacttcagcaagtgatacagcaagaattcgaactcacatctttgtgatctcagcgcctgagcttttaattactactatatacccacggtttagtagtaactcatacatgtgatgagagacagaaatgtttaaaagccctaccaatgagataaatcatgtaaagaaaactggcctatgttataaataggctaggagcaagatgaagcaagtgaccctgaaagcgagggcctcagctgggtgcagcagctcatgcctgtaatcccagcaatttgggaagctgaggtgggaggatcgcttgagtcctggagtttgagaccagcctgggcagcatggtgagaccccgtctctaca

SEQ ID NO: 42541 - DNA, 464 bp, Homo sapiens
acacaggggcagttgctgtaggtaggtaggaacaggaagattagctagattatggaaaggttaggcaaaaatgtaggaactcttggttgaagaatatttcaagcttgaatgacataaagggaagaagcacaaacgggaggaatagtttgggtgtttaacagctcaagggagaaacgatatagctacagtccttggttttgtgcagcactctttttgaagccagtgatcacagcaaaaacaagaggaggtgagataagagcttctgtgcagtagagcatccacacagaagggtgcaggatgcagcagcaaatggaagttggctatatacaggggaattgattaaatatgtaaacatattatagataaaagacccattatcgctattagagaaggaaattacaaatataggaaggaacaaaaccagaatgaatcctgtggtgttggatgggaattgattatatcag

SEQ ID NO: 42542 - DNA, 475 bp, Homo sapiens
aaatttgcaaatatcaatgctaaccttgaatgcaaacagggaaaacaccccacttaaaaggcaaagagtgataagttgaaaaaagaagcaagacccaatggtatgctgtctcacatgcattgacacccataggctcaaagtaaacggatggaaaaaaaaatctaccaagcaaacagaacacagaaagcagtagggcttgctattttaattttagacaaaacaaagtttaaaccaagaaagatcaaaaaagacaaagaaaggcattacataatggtaaagggctcatttcaacaagaagaatgagctagcctaaatatatatgcatccaatacaggaccacctatattaataagtaagttcctagagacctaggaagagattcagataaccacatgataatagtgttggacttcacctctccactgacagtattagaaacataatcagagtcaaaaactcacaaaaataaagcata

SEQ ID NO: 42543 - DNA, 446 bp, Homo sapiens
agatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacgagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttat

SEQ ID NO: 42544 - DNA, 382 bp, Homo sapiens
catggtggctcacgcctgtaatcctagcacactgggaggccaaggcaggaagactgcttgaggtcaggagttcaggagactcccgtctctataaaagataaaaaaaaattcggggtggctcacacctgtaatcccaccactttgggaggccgaggcaggtggatcacaaggtcaggagttcaagaccagcttggccaacatggtgaaaccccgtctctactaaaaatacaaaaaatttagccgggtatggtggcaggcgacggtaatcccagctcctcgggagactgagacagagaattgcttgaacccaggggtagaggttgcagtgagctgagatcgcactactgcattccagcctgggtgacagagcaaaactccatct

SEQ ID NO: 42545 - DNA, 215 bp, Homo sapiens
  misc_feature 11, 15, 32, 47: n = A,T,C or G
ctggccgggcngatnctaaaaaatactaaatnataaataatactttnaggtagtgatgagtgatgcaggaaacaagagaagatgattgtggagtgagtgattactacgggtgaggtccagtgatagagaggactagtgaagagggaagacagtcagtctacacaaagatcatcctgttgaaaaatatgaaatatgcaagtctttggaatttaccc

SEQ ID NO: 42546 - DNA, 465 bp, Homo sapiens
  misc_feature 32, 183: n = A,T,C or G
caacctggtgtttttatttgaggcgccagaantagaggtgcagtcatacagaaggcagatcatctctttgaacaagcccccatcccgtagctattacgggttatttttccagaagctcagtgaccaggatacatagtgagaagtaaaaaatataaaatattgttacaggaagggatttgtcangaaagagtcagaaatgtgaaagccctaaggaagagaaaggatgtcaagaaacatgaaaaagggaagaatgagggaattgtcagcaagggccattctctacatgcaggtgtagagaaaacaagggggtgattgagaggagtcaacagcctcatggtaataataaaaatcttcatcttagccaggcatggtggtatgcatctgtaatcccgtgctttggaaggctgagacaggaggatcacctgaggcccggagttggagaccagcctaggcaacatagtgaga

SEQ ID NO: 42547 - DNA, 471 bp, Homo sapiens
  misc_feature 101: n = A,T,C or G
gttgaggctaaggattactagaggaggagaacttcagagtagcaaataatcagacctccatccaggaagatggacgtgggtggtctgacatgggagcctantattttgaaagctccttaggtgattctaatgtcagcagggctgaaaatccccctccttaagcacatgggcacttaggagggggtctaggttacattgtggccaagtctgcagtttacagttctggacaagaaccccaacccccaatttatgctatggtgatagctgtgctctgattgagaaggtgcccttaggtacttgagatggcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaac

SEQ ID NO: 42548 - DNA, 431 bp, Homo sapiens
aggtagataaaattaaacagttttattcagaataagttaattcttccagaatttatatatttaaagactccaaatatacatccccagtggtatcttggactgttaaatagaaaaatattgttgctcttaaaagaaattcagtgaagtatggttataaagtcagaatgtctaatacttttggtcagagtcaaacagcagttccaatataggcagcaagttaaaggggtagttggtggcctgtgttgaaagcgacttgatgaaaataaatctttaaattaaactttagtagaataaaaagaaaaagcagagccaggtgacgcagtggatcatgcctgcagtctcggctactcagggtgctgagggtggaaggatcacttgagtctaggagttttgagaccaacctggacaacatagcatgactctgtctcgca

SEQ ID NO: 42549 - DNA, 493 bp, Homo sapiens
  misc_feature 3, 4, 28, 30: n = A,T,C or G
agnnccaggaatgctgcgctgctgctgntntgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctg

SEQ ID NO: 42550 - DNA, 469 bp, Homo sapiens
gagacccttcttactcctgaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagccccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctga

SEQ ID NO: 42551 - DNA, 105 bp, Homo sapiens
  misc_feature 35: n = A,T,C or G
ctggctctttactggccggggttttctttaaactntttctaatactctagtatgtatatttcttaatttaaaaaaagtttcaaatcagacaaaactctctaagcg

SEQ ID NO: 42552 - DNA, 133 bp, Homo sapiens
aagaaggaggagatcatcaagtactttatccaggaggaagagaccaagaaataaaacctcccactttgtctgtacatactggcctctgtgattacatagatcagccattaaaataaaacaagccttaatctgc

SEQ ID NO: 42553 - DNA, 500 bp, Homo sapiens
  misc_feature 24: n = A,T,C or G
gctgcaatttagcatgttggaacntctagggagaaggttgacttttcgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaattt

SEQ ID NO: 42554 - DNA, 465 bp, Homo sapiens
  misc_feature 5, 19: n = A,T,C or G
ccagnaatgttgccaaggnaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatg

SEQ ID NO: 42555 - DNA, 462 bp, Homo sapiens
ggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaaggtgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatc

SEQ ID NO: 42556 - DNA, 257 bp, Homo sapiens
aacacaagaacagaaaaccaatactgtatcttctcatttatagtgggagctaaacattgagtatacatggaaacaatgaggagaacaatagacaccaatgccttctggagggcagaaggtgggaggagggtaagggttaaaaaactaccagtcagttactgtgctcattacatatgtgatgaagtcatttgtacaccaaaccctattgacacgtaatttagccatgttacaaacctgcacttgttcaccctgaaccc

SEQ ID NO: 42557 - DNA, 486 bp, Homo sapiens
accaccgccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcag

SEQ ID NO: 42558 - DNA, 394 bp, Homo sapiens
  misc_feature 140: n = A,T,C or G
ggccctccctgcgccacacggccgtcgccatggtgaagctgagcaaagaggccaagcagagactacagcagctcttcaaggggagccagtttgccattcgctggggctttatccctcttgtgatttacctgggatttaanaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagcga

SEQ ID NO: 42559 - DNA, 371 bp, Homo sapiens
aagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtga

SEQ ID NO: 42560 - DNA, 469 bp, Homo sapiens
  misc_feature 6, 31, 32: n = A,T,C or G
gtatgnccgctatccgaacctccactctttnnacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgctttt

SEQ ID NO: 42561 - DNA, 392 bp, Homo sapiens
aaccagcgtcaggaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaat

SEQ ID NO: 42562 - DNA, 214 bp, Homo sapiens
  misc_feature 6: n = A,T,C or G
gacttnaagcgctatttataaccagccttcagaaagtattggtgaatattcttaaacagaatggaaatgacaaagcatggagtccataaattagatgatagtttggaaaaagatataaacttacaaaccaagaagctcagtgaaccacacaactggataaattaacaacaaaagtccaagcttagacacatcataaagaaacttctgaaaacta

SEQ ID NO: 42563 - DNA, 477 bp, Homo sapiens
aggcatgagctctgcgcccggcctgttgctcttctttctacttttttgttttgttttgttttgttttgttacacaacacctcttcatttttgttctccatcatatctagtggcaatcctgctcctagaaaccaaatagtaacgagtatcttcgtggatcttccacctcttgcattgaaatctggattttttttctcttatctgaatttcgttacctctgctgcacctaaaaggaaatacatgctttgcacattcccatgtagactccacgtgcagctcagagttagattgtttccagagccaagcgctttgtgagataagtaacagttacttactggcacaagggcgggtttgagtttctgtccttttcaccatttgaggcttttaccaacactgctttggcatttaacattgttgggactggagtatggctgttaaagtacgaattgtgaattgtgaattgtgggggagcagagtg

SEQ ID NO: 42564 - DNA, 469 bp, Homo sapiens
agtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaac

SEQ ID NO: 42565 - DNA, 158 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcactcg

SEQ ID NO: 42566 - DNA, 193 bp, Homo sapiens
gaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgg

SEQ ID NO: 42567 - DNA, 485 bp, Homo sapiens
  misc_feature 13: n = A,T,C or G
tggagtgacggtnatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagtctcgctctgtcacccaggctggagtgcaatgccgcgatctcggctcgctgcaaccttcgcttcctggattcaagcaattcttctgcatcggcctccccaagtgctaggattacaggcgtgagcctccgcgcctggcctcatttttaatttttttagagacagggtttcactctgctgcccaggctagatggcagtggtgca

SEQ ID NO: 42568 - DNA, 268 bp, Homo sapiens
attactgtttctggtcctcgtttttgtaattaatgtttctagtcctcctctttgcccttaagcaggtatgtgttttctttctggagctggaattttgctaattaatcatgtgactactccagagactctttaaatctagttttaaatctaatctgtagcagcaaattatcaagaaagcctttaaaattaaagattctaaggtggaatgattgcttgaggccaggagtttgagaccaacctgagcaacatagtgagacctcatctctcc

SEQ ID NO: 42569 - DNA, 299 bp, Homo sapiens
cactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatc

SEQ ID NO: 42570 - DNA, 344 bp, Homo sapiens
  misc_feature 6: n = A,T,C or G
agaaancggactgctaaatgatcctatttgtattttctgatgctatcagactctaatgtttttttccctaaaatattattgccatcatgctttaggaattttatatttttacataatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacat

SEQ ID NO: 42571 - DNA, 296 bp, Homo sapiens
  misc_feature 2, 278: n = A,T,C or G
tnttggcccggggaaggataaaagagagggaaaggatacttggggagtttagaagtggcagaagtatctgtagaagccttacggtgtgaatgtgctggattgtgtgtgcccaccctcatgggggacttccttggaggatgagggtacaccagcatgggcagcaaagctgtttgacctcaaggtggagatctgagccacctggtcagtccatgcccagttaatttctatggaggtttggtaaagtaggttagggagttggatccaatgttcctgaagtntctgttggtaatatggca

SEQ ID NO: 42572 - DNA, 266 bp, Homo sapiens
  misc_feature 10, 42: n = A,T,C or G
tgggcttggnctggcactaaatgacctgtctttttggtagtnccaagattgacatgtgtcctgccaacatcctgcaaggtaagtgaagcctccagctagcagcagcccctctgattggggctgtcacctgctgtgccttcaggtggtctgctaccacggctttagcccagaaacttcttttcttttttatttttatttttttattttacaatatgtttatttttattatgtgctctagcctgggtgacaagaacaaaactccatat

SEQ ID NO: 42573 - DNA, 485 bp, Homo sapiens
gattgcagatattttagctagggcctggtggctaggtcggttctctcctttccgtcggagacctctgccgcaaacatgctccgccagatcatcggtcaggccaagaagcatccgagcttgatccccctctttgtatttattggaactggagctactggagcaacactgtatctcttgcgtctggcattgttcaattcagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaata

SEQ ID NO: 42574 - DNA, 143 bp, Homo sapiens
  misc_feature 73: n = A,T,C or G
tcggcctttctggccggggtttatgtttacgtgtagatactgtatatatactgtattcatttaattttggtcntttgaattaatttcttttatctagcattatataaataaaaatagaagtaatttctaaaaacgttcacatc

SEQ ID NO: 42575 - DNA, 311 bp, Homo sapiens
  misc_feature 2, 6, 72: n = A,T,C or G
tnctgnaggctccttagaatcgctgtactagaacactataagaaatacaaatagatagcagggcagtgtcangtccatcctcttcacgtagttgtctgagaatcatcttcccaccagatggttttggtataagatgagattcacactgggtgtgtgcgggagctttcctggctttgaatccgtatactcatagcagtcattacctcttgcagcaactccaaaggtatggatttacgattcccacagtgcacataccaatcaattatgagagttgctgtactcagagaagttcagagatagggctgtctatt

SEQ ID NO: 42576 - DNA, 178 bp, Homo sapiens
  misc_feature 14, 24, 43, 140, 168: n = A,T,C or G
tggggtgagttttntcccgggaantcggccttgtggccggggnccaatgtgaattataaatgagaaatccacagttattcattgtggagttgttgagactatgaaagactcattgtctttgtattcagctcttaaatagngtaactatatccccacctctgcttgctntctttccctc

SEQ ID NO: 42577 - DNA, 397 bp, Homo sapiens
  misc_feature 6, 15: n = A,T,C or G
gcaccngaatgtatnttaaggtgtggctttaggagcagtgggagggtaccagcagaaaggttagtatcatcagatagcatcttatacgagtaatatgcctgctatttgaagtgtaattgcgaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatat

SEQ ID NO: 42578 - DNA, 472 bp, Homo sapiens
gatctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaag

SEQ ID NO: 42579 - DNA, 313 bp, Homo sapiens
  misc_feature 307, 313: n = A,T,C or G
catccacaatagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcagctgagggaaaaagaaacacaacaatagtttaagaaattttttttttaaataaaaaaaaaaggaaaagaggaagactggccaaaacancccaan

SEQ ID NO: 42580 - DNA, 395 bp, Homo sapiens
ggaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaatagataattcctgaagaatgaagaagattaattttgggagttctttgacgaactttgatatgtggaaaaagtatttataatttattgtaagaagaaagtaaaatattactagt

SEQ ID NO: 42581 - DNA, 471 bp, Homo sapiens
  misc_feature 1, 29, 31, 130, 184: n = A,T,C or G
nggtactgggagatacagcctccaccttnanatgtgtctacgtgcgctctgccattcaactcggaaactataagtaattctcaagaaagccctcatttttataacctggcaaaatcttgttaatgtcatngctaaaaaataaataaaagctagatactggaaacctaactgcaatgtggatgtnttacccacatgacttattatgcataagagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattaagcagttagctcatttgagataaagtcaaat

SEQ ID NO: 42582 - DNA, 466 bp, Homo sapiens
  misc_feature 128, 167, 213, 268, 317, 343, 373, 386, 392, 433, 446: n = A,T,C or G
cagtgaaagtatgtaataaataaatgaggggttggcaaactactgcccaccatctgttttttatggcctatgaactaagaatcgttttggatagctaaaaaaaaaaatcaaaaggataattattttgngacgtgaaaattatatgaaattcaaatttcagtttctgngaatgaagttttaatggaacacagccatccatgcttatgtaagtgngcatattctctggctgttttcactgcaatagcagagttgagtagttgtgacaaanagtttatggcccacaaaacctaaaatatttactttctgatgctttacanaaaaagtttcctgaaccttattctanctatatgttgttcataaatgaatctttcgnggttctgaaggcntttaanaatctcttaggttataaattggctgggcgcagtggctcacncctgtaatcccancactttgggaggccgaggct

SEQ ID NO: 42583 - DNA, 421 bp, Homo sapiens
gggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactg

SEQ ID NO: 42584 - DNA, 215 bp, Homo sapiens
  misc_feature 161, 179, 197: n = A,T,C or G
ggaggcagaggttgcaataagctgagattgtgccacagccctccagcctatgtgacatggcaagaccctgtctcaagaaagagaaaacacatcacagaagaggaagggagattcttttgtagttgctacgtgtgacgacagggtgttcacacacatgtgtnagatgtaccaccctccanccttgttacaatgtcgcnacattacccgaccgatac

SEQ ID NO: 42585 - DNA, 200 bp, Homo sapiens
aaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtag

SEQ ID NO: 42586 - DNA, 430 bp, Homo sapiens
ggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaagggggtctgttctgcagtgggagaagacattctggtgaccaga

SEQ ID NO: 42587 - DNA, 377 bp, Homo sapiens
  misc_feature 14: n = A,T,C or G
attgattcttaagncttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgcttttcatgaccataatttatttttaaaaataaattaaaggttaattatatgcatgtatgtatttctaataattaaaaatgtgttcaatc

SEQ ID NO: 42588 - DNA, 436 bp, Homo sapiens
caactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatccca

SEQ ID NO: 42589 - DNA, 101 bp, Homo sapiens
  misc_feature 15: n = A,T,C or G
ggtgctttgagggtnagcctttaggaaggtgcagctttgttgtcctttgagctttctgttatgtgcctatcctaataaactcttaaacacaaaaaaaaaag

SEQ ID NO: 42590 - DNA, 498 bp, Homo sapiens
atggctcgggggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctat

SEQ ID NO: 42591 - DNA, 316 bp, Homo sapiens
gaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcggatcacttgaggtcaggagttcgaaaccagcctgacttatgtgatgaaaccctgtctctact

SEQ ID NO: 42592 - DNA, 219 bp, Homo sapiens
  misc_feature 7, 8: n = A,T,C or G
agaaganngagacgacaatactttgtcatatggaatgctgttttatttcttgtttaaaatagaagtattaaatgtgcaataatttttattttgtctgaagatggtgataccagtgcaactgagagtggtgatgaggttcctgtggaattatatactgcatttcagcatactccaacatcaattactttaactgcttcaagagtttccaaagttaatgat

SEQ ID NO: 42593 - DNA, 425 bp, Homo sapiens
ggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctggggattttgttttttattttgaaatgggagcttttttgtttac

SEQ ID NO: 42594 - DNA, 438 bp, Homo sapiens
attgcagcactactccaacagcgaagacatggaataacctaaatgcccatcaacagtagactggataaagaaaatgtggtatgtacataccatggcgtactatgcagccataaaaaagcacaagatcatgtcctttgcaggaacctggatggagctggagaccactccagctctaagcaaactaatgcaaaaacagaagaccaaatactgcgtgttctcaccaataagtggtagctaaatgatgaaaacacatggacacatagagggcaacaacacacactggtgcctacctctgagggtggaggatgggaggaaggagaggaccaggaaaaataataggtactaggcttaatactggggtgatgaaataatctgtacaataaattcctggggcagaagtttacctatataacaaacctgcacatgtatccctgaact

SEQ ID NO: 42595 - DNA, 468 bp, Homo sapiens
  misc_feature 454: n = A,T,C or G
aaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtnaaaggttaaataac

SEQ ID NO: 42596 - DNA, 457 bp, Homo sapiens
catctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgca

SEQ ID NO: 42597 - DNA, 471 bp, Homo sapiens
cacctccgctacctaatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctcta

SEQ ID NO: 42598 - DNA, 206 bp, Homo sapiens
atttttatgatgtaatattgtattataattctttctgatagtcttaagattataggaataactttatgtagtataaaacctggaaagatggaagagttgagagtgacagcagctcttacttttttattctatatacagtaaaatggcactttaataatattggaattctccagattaatttattgtcagttttgtaattttggcac

SEQ ID NO: 42599 - DNA, 394 bp, Homo sapiens
cttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtgaccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagc

SEQ ID NO: 42600 - DNA, 114 bp, Homo sapiens
  misc_feature 52, 85: n = A,T,C or G
gacttaaaaaatacatttaaaactgctcttctgctctagtaccatgcttagngcaaatgattatttctatgtacaactgatgctngttcttattttaataaatttatcagagtg

SEQ ID NO: 42601 - DNA, 107 bp, Homo sapiens
acctacaagtcccgtaaagcatggccggcccggcatcggggccacccactcctcccgcttcatccctctcaagtaatggctcagctaataaaggcgcacatgactcc

SEQ ID NO: 42602 - DNA, 397 bp, Homo sapiens
  misc_feature 19, 80, 96, 260, 321, 395: n = A,T,C or G
cccaataaattttaaaatngcttgtctatactgacaaactatattcccatagagatttttttttcttgtcttattgaagnggctaggattactcangacagtgttcagtctttcttcattaaatgacattgtaggtgtagtgtttttgtgaatgtcatttaataggttaggaaaaattatttttatttctagtttactgcaataattttttaaatcgttaatgaacattaacttcttcatactatttttctgcatcagtnggtaaaatcataggggatttcttttcggactgttaatataatggcttttataggttgattntcaaatattggtctggccttgcattacctggataaatccccctgaattgaggtgttgtatcctttttatatatntg

SEQ ID NO: 42603 - DNA, 351 bp, Homo sapiens
  misc_feature 5: n = A,T,C or G
gttcngcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaac

SEQ ID NO: 42604 - DNA, 457 bp, Homo sapiens
  misc_feature 383, 390, 391, 456: n = A,T,C or G
aactgatgactttgtgtaataaagacatcctgacactttttttctttcagctcatatgttagatttgatatcattcgaaggatcctaaccaaggtttttggatgcagcatagtcatggtgatgggtattacagatgtagatgataaaatcatcaaaagagccaatgaggtaagtggagaagagttacatctattgataatgccattgattagtgttctgagcccttcctgaaagtggttcttggccgggcgtggtggcttacgcctgtggtcccggcactttgggaggccgagacaggtggatcgcttgaggtcaggagtttgaggccagcctgacaaacatggtgaagccttgtctgtactaaaaatgcaaaaattagtcangtgtggnngggcgggctcctgtagtcccagctcctcaggaggctcaggcgggagaatcgcttgaccctggggng

SEQ ID NO: 42605 - DNA, 101 bp, Homo sapiens
ggggaggctaaggtaggatacttgatcccaggaggcggaggttgcagtgagttgcagtcacacccctgcactccagcctgggtgacagctagaccctgtct

SEQ ID NO: 42606 - DNA, 183 bp, Homo sapiens
  misc_feature 20, 91, 136: n = A,T,C or G
gggcttggagcattaaggcncgcccctattccgcattctactggggccctggttacgcctcctctggctcagtcacacagctgcctggtangtgactggaggccttgatcggttcttattgggattttgctgctgnggccccaacccttcctccctccccaccctgcaatggcaggagaaact

SEQ ID NO: 42607 - DNA, 311 bp, Homo sapiens
gtaaaacagagacaggaatgtccactgcccacttcacagagtgagagggtaatgaatagcacatagcctggtctgtggcatttatttgttgcttaatacaggtttgtgtactttccttaaaagcccttgaatgatgtataactttatagggataggataacagagtttggacatatttgtagaaggaaatgactttaaacatcttgacaattatgtgagtgagagattatttgcagtttgctaacatttcctaaagctgtggtgtgtgagatacagtaacacacacatttttttttaaaagcaaccaaaga

SEQ ID NO: 42608 - DNA, 496 bp, Homo sapiens
  misc_feature 4, 12: n = A,T,C or G
cacntatagctnttatggatcgggatgtacgtgaagagcatgaagggtctcgcgggaatccgggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagtccttgtgtacagaacttctgttctgccctggattctactgctgaaggtt

SEQ ID NO: 42609 - DNA, 451 bp, Homo sapiens
caggaaaaattatccgtgttaccatgctaggtaatttgtacacagaaagataaatttggagactgtcattatccatttatttttcattagttctttatccagcccttagcatatatgtgctagacactactctggaccctgggatataacatgagaacaaagagagaaaaatccctatagtggatctagacatgagatctcaaaataatgtggtattatacctccctggggactagaaagcttatataggaataactgactaattcagactaattccagaggccagttaatgtgagtcatcatgtagccaagaactcagaaatcagtcactaagtctgcatactaaagcttatcccataactgatgagagccctccagtctctattgttttatttgtatcgttgcagtgaccttaattatctgatcccagttgatagagaagattagaaac

SEQ ID NO: 42610 - DNA, 473 bp, Homo sapiens
  misc_feature 12: n = A,T,C or G
gatctcctgttnaccaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagacgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatga

SEQ ID NO: 42611 - DNA, 419 bp, Homo sapiens
gggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatgggggttgagaagaaga

SEQ ID NO: 42612 - DNA, 470 bp, Homo sapiens
atctcactctttaatctggtagcactgaggtgggcagtgtttctgagtgttttgtgtgaacccatgaagagaaaatgttagaactaggctttatgcccatggagtgattcttctacagtttcttagttctattaaattttaaaaatatcttattgcttccacagaagagaaatttttagaatatgggaagagcgaatataacattttgttcaatattaaaagttaatttaagacagaaccagaggccaagacaagtgtcttctcttttcttcatttggtgatataattgaccctttgtacctgcgtacaacttaatattcattcagcagaggctaattatgggatgcgtagatgccacatggttaaggtgaagatgcagatttctgtgtgagctgcttaattctgacggttataacttgtccataaaatttgctatggattgtaacaagtggaatattaactcggaattg

SEQ ID NO: 42613 - DNA, 195 bp, Homo sapiens
gggcatctgttggactttcccctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgt

SEQ ID NO: 42614 - DNA, 100 bp, Homo sapiens
tcccgcccccagattgataagtaatgaaagtgcactgcagtgagggtcaaaggagagtcaacatatgtgattgttccataataaacttctggtgtgatac

SEQ ID NO: 42615 - DNA, 392 bp, Homo sapiens
gagacctaaaagaaatggtacagagcagcctgttgaaattagacagcagggtcaccctggtcctttgtgccacaggaaggaggggtactgaagtgtcagttgttggtgggggagcagtgctgcagtgggaattccagagctgagaaggctgccatcaaccaagtgagacatgaccagcccccgagttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttg

SEQ ID NO: 42616 - DNA, 345 bp, Homo sapiens
atataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtaga

SEQ ID NO: 42617 - DNA, 470 bp, Homo sapiens
  misc_feature 235: n = A,T,C or G
acactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttangtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaat

SEQ ID NO: 42618 - DNA, 288 bp, Homo sapiens
  misc_feature 2: n = A,T,C or G
tnatgtgtttttgaaagtgttattgtttaaaaaatgaaaaaagcatatctgctaaagagctgtcagttttcattactgactccgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaattt

SEQ ID NO: 42619 - DNA, 407 bp, Homo sapiens
  misc_feature 259, 270, 377: n = A,T,C or G
gggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttangttaacactanggactgcgtccatgtactagtataacagcttgggtttgttagaatttgggcaacattttgattataatgacaacttcattttcacatgttactcagttccctaatangatggtgctcttttgttgaacctgtattga

SEQ ID NO: 42620 - DNA, 247 bp, Homo sapiens
actccgctggttaaaaatgttgcacttatcagcaaccctaccacttttatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 42621 - DNA, 440 bp, Homo sapiens
  misc_feature 38: n = A,T,C or G
gtgctgaagaagcagcagcccaagagcagacgggtcangtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttatgcagcaaaggtggccccagcagatggcttctctgatcttgccatgcaagtaatgacgtctccatctaagaactacattctctctgtgatcagtgggagcatctgtatattgttcctgattggcctg

SEQ ID NO: 42622 - DNA, 500 bp, Homo sapiens
  misc_feature 17, 297: n = A,T,C or G
acccagggaattcggcnttatggccggatctgtgtgtccggcaaggggcaaggaaagggctatgtggttcaaaacaaatacaaaccatacaaatacaaagtaatacaaaccaaaacaaacaaatacaaaacaaatacaaaccatacaaatacaaagtaatacaaaccaaaacaaacaaatacaaaacaaatacaaaccatacaaatacaaagtaatacaaaccaaaacaaacaaatacaaaacaaatacaaaccatacaaatacaaagtaatacaatagaataattgtattactaangccccaagcccctatgctgctgaaccttctctctgtggaatgaaaatggtaagaagaggaaagaaagaatttctgccagcagtggcagaaaaagtagatgctcctagcggagttggaggtcaaggacaggacagtgtcactgtgggatccctgggcagacgttctacctatggcaggtggtatggggggcgttaaaatatatt

SEQ ID NO: 42623 - DNA, 241 bp, Homo sapiens
gtgccctaaatatcttctcaaggaaaccttggctttaaaagtgattgtttacttaaacaaataaaacaacaacatacaagaaaaggcagtaaatccgagcgtccatcaacaaatgaatcaaaaaacaaatgagatatatatgtacggtggcatattattcagccttaaaaaggaaagaaattttgacacatgagacaatatgaatgaaccttgaagacattaattatgctgagtgaaataa

SEQ ID NO: 42624 - DNA, 137 bp, Homo sapiens
gtctggagttgttcgttcctcccagtgggtttgtggtctcgctggcttccggagtgaagctgcagacctttgcagtgagtgttacagctcataaagacagtgtggacccaaagagtgagcagcagcaagatttattg

SEQ ID NO: 42625 - DNA, 370 bp, Homo sapiens
atttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtac

SEQ ID NO: 42626 - DNA, 444 bp, Homo sapiens
atcctagtgtttgtgtattttgctttatccctactaccacttcccttaaatactgttcactgtcatctttcacttagacctgcactgtccagtaccatagccactagtgtcaggtgactggtccaaattgagatttggtgtgagtgtaaggtacactggtatttgtagccttagtatgaacagataatatatatggtcatattcctaatttttttcgattatatgttaaaatgatattttgaatatgtaaagttaaatgcattatcaaaatttcatcttttttgccattttattatatgtggctactaaaaaattataagtaatcagactgggcgtggtggcttacacctgtaatcctagcactttgagaagtcaaggcaggaggcttgcttgaggccgggagtttgagacctgcctgggtgacataacaagatcccatctctt

SEQ ID NO: 42627 - DNA, 471 bp, Homo sapiens
gcactaggtaggaatcctgctctgaacatctcaggaggagggaatggccatggggtgggcggaatcacacagcgagtcttccagaagcaatcgtgaatctccatcttccacctgccacctgggttgctagctaaaatacaggatacccagtgttttaagttggaatttcagataaacaacaaataattctttagttaggtatgtcccgagtagtgcatgcatcctgtatttttctttgctaagtctggcaaacctacctggatgaccacatctgcctgctcctcggcctctcagctttccccccacacccacacagagggaccctgtaaaaacccaactcacttaacctccagccactcaggcgctgggtgatctgggcctggcgagttctctgacctcatctcctacccccagtgatgtgctggtaaagtagcacgtcccgttttctgagaaaaaaataaaatatagaat

SEQ ID NO: 42628 - DNA, 462 bp, Homo sapiens
  misc_feature 11, 450: n = A,T,C or G
ataacgctttnataactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcangttcccagcact

SEQ ID NO: 42629 - DNA, 303 bp, Homo sapiens
gtatacagttaaagaatgttccttctgctaaatctaattgtagttaacccatatgctaagtacttaatttcagttattgtatttttaagttttaaatttccatttcattctttcttatagattccagttctttgatgaaagtctctattccacccatcaagtctgtgtctgataacaccaatatctgggtcattagtggctccgttttgttgtgtctgttttcccctccttcctgttttgtggtgtgtttgatcacctattgttgaatgctaaccattataataaattttagtggctccagga

SEQ ID NO: 42630 - DNA, 285 bp, Homo sapiens
gggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagt

SEQ ID NO: 42631 - DNA, 406 bp, Homo sapiens
  misc_feature 14, 33: n = A,T,C or G
agcataagctaatntatatggacagctaatttnttcccccttatggaaatctgccaaactccactatactttcaattgcaataaaatagcttcaggcaaatctgactttttatctacttctttgtgtactgtaaaaataaaactaaaacaagtttttactctgaaaagcttgtcgtttcaaaatgtatagtattaataactatgaagccatacagttatcactaccattacttggtgtttattttcatttattttttcctgggtattgattttgcatagttggaatcatagcacaaaataattttgtccatttttatataaaagggctattaacctttgttaatttcattccagtttggtaattggcttccacttcattactgtatatgggatgtttatataactg

SEQ ID NO: 42632 - DNA, 471 bp, Homo sapiens
attgtaaacaggttacagataggcatccctgttagtactatttttatttaacatagtgttagtagtttaagacaaaataaaatgttgaagaatagattaaaataactgtgcaaaagatagtaaaaggaggatttgccttttcgcattttagattatagcaatatgtaaacatttaaggaacagaaaagtatattagtagaacaagtagagagtgaaaaaattctggtacaaattgggaaattagtatataacaacatagtgttaaattcaatgggaaaagtttaataagagggattttggtatcaactgggctgtccaaagataaaaatgggaccgtcctatcacatacaaaattgtttttttagataaagatttaaaatacaggcactccttcatttgcgtggtgcaccttgaggtgttgcagaaatgatgagagctgaaactgcaaagcaattttaatacttatctgtt

SEQ ID NO: 42633 - DNA, 111 bp, Homo sapiens
  misc_feature 31: n = A,T,C or G
tccttctaaatcaccattggtaaaatgaaanatcatcataaacagcatggcaacatttgcaagtacataacaatctattaaaattcatgatacaattaattatgttaaagg

SEQ ID NO: 42634 - DNA, 309 bp, Homo sapiens
aaggttctggtttttggagtttttccctttttttgggataacctaaccttggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaactaaagaaactggttgttttaaga

SEQ ID NO: 42635 - DNA, 393 bp, Homo sapiens
ggctttagggactggacttgcagtgtaaatagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgattt

SEQ ID NO: 42636 - DNA, 100 bp, Homo sapiens
attggtaaattttttattttcttattttttgtcttgcagtcgaccaggctggagtgcagtggcacggtcatggctcactgcagccctcggcctccctggg

SEQ ID NO: 42637 - DNA, 367 bp, Homo sapiens
  misc_feature 6, 16, 39, 115, 277, 289, 335: n = A,T,C or G
agaacncggttttttngtttgtttgttttttgtttttcngctttagacttgaaaagagacaggcaggtgatctgctgcagagcagtaagggaacaagttgagctatgacttaacntagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttttaatctactgcntttaggggagtnttctaataagctagttgaatacttgaaccataaaatgtccagtaanatcactgtttaaatttgccataaagtacactg

SEQ ID NO: 42638 - DNA, 498 bp, Homo sapiens
  misc_feature 7, 15, 34, 38, 57, 58, 67: n = A,T,C or G
tacagcntaagtaanactgctctgcactgtttantccntttccaggggctttagaannagctaacangggtgtgtccccctgtcctgcccccaccggtttgctggctttgtaataacataagaccattggtggttgttggtgtcagataccttcccatcctgagctctctcacctacctgttctctctcctagagcaggatactggggtacttttaagaaagggtgctccttttaagatgcccagaaaagctgtatttaactcttgctatttgtaacttgggggatggtctcccctgccccagggcacataagaagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccct

SEQ ID NO: 42639 - DNA, 366 bp, Homo sapiens
  misc_feature 2, 8, 29, 30, 35, 53, 91: n = A,T,C or G
tngcccgnggggaccccgggagccaaganngcganttccgggcaggcagaatnttgttctgagaagcccagaaaaagggtattgggcttanttttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtattttatgatgaaatgcagaaaaaaaaggaggaaaataatcccaaattgcttttgggggaaagacagaaagcccg

SEQ ID NO: 42640 - DNA, 207 bp, Homo sapiens
  misc_feature 12, 52, 55, 57, 70, 83, 99, 114, 115, 142: n = A,T,C or G
gggggataaccnacccctaccctgttcttgccctaataagtttctttttaantcnantccctaacacttnagttctcttcacnggttttacacagaganatacaaaataaaganncacacactcaagacctctctacaaaantttcttctctctttacagaaagaaaagcatgcatatcattaaacaaataaaatactttttatcac

SEQ ID NO: 42641 - DNA, 234 bp, Homo sapiens
  misc_feature 16, 23, 44, 66, 229: n = A,T,C or G
taagcacctctaaganccgagtnagcttcctgaaacgtgtgaanggaaaatgattcagaaaaaganagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctntgggc

SEQ ID NO: 42642 - DNA, 470 bp, Homo sapiens
  misc_feature 13: n = A,T,C or G
ctgagtgtctgtnacaactagattaccagagatgcttctggactcatttaaaagatctttcccttctctccattcatatttgatgctaacaggtgctaaattggaattgggaattttcttggattaatgtagcattttgaaaaacaaaaaccagaatctcggtatataataaaagtacctctcttgtaggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagag

SEQ ID NO: 42643 - DNA, 186 bp, Homo sapiens
  misc_feature 5, 8: n = A,T,C or G
ggagnaantcccttctctacctaaaaatacaaaattagccgggcatggtggtgcattgcctgtaatcccagctactcaggaggctgaggcaggagaaattgcttgaacccaggaggtggaggttgcggtgagtcaagattgtgccattgcactccagcctgggcaacaagagcaaaactcggtctc

SEQ ID NO: 42644 - DNA, 101 bp, Homo sapiens
  misc_feature 21, 28: n = A,T,C or G
agagaagccttccgtgtgttngataaangatggcaatggctatattagtgctgcagaacttcgccatgtgatgacaaaccttggagagaagttaacagatg

SEQ ID NO: 42645 - DNA, 497 bp, Homo sapiens
  misc_feature 8, 10, 41, 45: n = A,T,C or G
cctggttntntttacctaagcataatgtctccaatgtttcntccntgttgtcgcaaatggcaagatttctttctcttttatggtgaaataatgtttgcaggctccttgacttacaatggggctgcgtccccatcaattcatcgtaaagtcgaaagagcgttaagtcctggatggtctgtctgtgcagtcacgtgtcacttaatgacagggataccctctgagaaatgcgttgtcaggcaattttcttctcgtgagcgtcatagagtgcacttacagaaacctagatggcttaacctaccactgcacacctaggctacatggggatggcctactgctccgaggccacaaacctgtacagcaggttactgtgctgaataccgaggcagttgttaacacagtggtgagcacctgtgtgtctagacatgtccacacatagcaaaggtcagtaaagtcaggcaccagtggtccacatcttgtagtcccacctacttttggag

SEQ ID NO: 42646 - DNA, 378 bp, Homo sapiens
  misc_feature 3, 7, 8, 11, 19, 32, 33, 41, 49, 63, 82, 145, 291, 303, 307: n = A,T,C or G
ccntgcnnccngggtggcntccgtcttcaganngtggggantgccagantctttcgtgaaganccctgacctgggtaaaganccctcacccctcgagggtgggagcccctgtgacacccattcgagaaatgtcaaaggcaaagantcccaagactaaagggaaaggcactccccttcctgatcagcagagggttgatctttgctgggaaacagcctggaagaatggacgcacccctgtctgactacaacatccagaaagagtccacttcttgcactttggtcctgcgcttngggggggggtgncttnaagttttccccttttaaaggtttcaacaaatttcattgcactttcctttcaataaaagttgttgcattccc

SEQ ID NO: 42647 - DNA, 295 bp, Homo sapiens
  misc_feature 19: n = A,T,C or G
agagtactgccccataatnccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattca

SEQ ID NO: 42648 - DNA, 278 bp, Homo sapiens
tgggcatggcggctcatgcctgtaatcccagcactttgggaggccaagaaaggtggatcacttgaggtcaggagtttgagatcagcctggccaacacggtgaaaccctgtctctactaaaaatataaaaattagccaggtgaggtgacaggcacctgtagtcccagctactcaggaggctgaggcaggagaatcacttaaacctaggaggcagaagttgcagtgagccgaaattgcagcactgcactccaacctgggtgacaaagcgagactctgtcg

SEQ ID NO: 42649 - DNA, 472 bp, Homo sapiens
  misc_feature 257: n = A,T,C or G
ggcagaagcggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttngggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttc

SEQ ID NO: 42650 - DNA, 461 bp, Homo sapiens
  misc_feature 442, 449: n = A,T,C or G
aaggtatgttgtaccaggaatctaggtgtctgggtgaccaggctgtctttcttcccactggggctcattttccttctatacagtgacaagaattggactaaataagatttccagtattttctcttctgaaacatttcattctttgttatccctgtactattttgttagtagaataaatcattgaagttgagttagaaaatctttagctaatcaaaatagaaaactaacaaaagtcatgacaggtcagaactgagaaataccacagacttccactggtgttcattggagatgactactattaaaaaaagagaagaaaaaaaaccatagctattttgaaaatttccgactacaggtgtctgagcatacatcctgactaaatagcatgtttacttcagctagagctcactccttcctaaataaaaggctacttggttttggtggnaataaantattcctctttg

SEQ ID NO: 42651 - DNA, 472 bp, Homo sapiens
aagctaaatacttttttaatttttttgatttccccttttaagttcaggggtacatgtgcaggatgtgtagatttgttacataggtaagcatgtgccctgatggtttgctgcacagatcatcacatcacctaggtattgagcccagcatccactagctgttttcctgatgctctgcctcctcccacccccaccctctgacaggtcccagggtatgttattcccttccacgtgttctcatgattcagctcccacttataagtgagaacacatggtgtttggtttttcttgttgttgttcctgtgttagtttgctgaggataatggcttcagatccatccatgtccctgtaaaggacatcatctcattcctttttatagctgcataatattccatggtgtataagtacctcattttctttatccagtctgtcattgatgggcatttaggttgatcccatgtctttgctattgtga

SEQ ID NO: 42652 - DNA, 319 bp, Homo sapiens
atgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttt

SEQ ID NO: 42653 - DNA, 470 bp, Homo sapiens
gaggatgaggatgaagcaaaggggaggcaggtgctcatagagtatgtagtattctaagcgttactaggctgggacttccccccaaaggtgatgacttcctttagtatgtgaatcttgaaatgaaagaggcacttacccaggttcagataaatgaggtgtccagcttagggcaggtgaactctgtggtaagagttatgatgacatcaggggacaggtttgcgcaaggcacactggacggaacatagagtaagatgatccagtggtgtctagaatgtggataatacccaatgtatttttgtttgatgattggaaaggagaaagaggcaatgccctttctcccttcccaggcttgggaagggctgatctgatgcatgctgtgaatatgagtcgacttactggcgagccaagtcctttcctggagagcagttttgaccagaagtggtagacaaaacaccctcgtccctggttgg

SEQ ID NO: 42654 - DNA, 353 bp, Homo sapiens
  misc_feature 21, 312: n = A,T,C or G
catcatggactataaccgagnatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcccctgctgctgtccatgactgtccttttgaaccaggaaaagtcgcagagtttaaagagaagcaaattaaacatcctgaatcgggaacaaagggntttatctaataaagagtctcttccattcacgttgctacctc

SEQ ID NO: 42655 - DNA, 208 bp, Homo sapiens
  misc_feature 2, 18, 47, 54: n = A,T,C or G
tngcccgggctgtttctntgggtggttattgtaaaagacctgaaganttactantctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccacc

SEQ ID NO: 42656 - DNA, 386 bp, Homo sapiens
  misc_feature 2: n = A,T,C or G
cnaggtacctcatataagtactgaggaatcatacaatatttgtcatttcgttactggcttatttcacttagcataatgtcctcaacattcatccatgttatagcatgtgtcagaatttcctttcactgaatgtatataccacgttttatttatccattcatccatggacattgggcaacccttgttatttttgaatggttggaatgcgtcagaagagagcagagcactttgcaaacttgatgggcagcacaaatgcaaaatagtgcggattatttagtgcctgaaagttgcctgttttgtgtctgtggggctatataaggccatgtcttacatataacctcctttaggaaaggagatgagtggggaaaacatttgaaacttgtaga

SEQ ID NO: 42657 - DNA, 217 bp, Homo sapiens
  misc_feature 3, 4: n = A,T,C or G
agnnaaatgttttacaaattactgtttctcactttcgtctaccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatca

SEQ ID NO: 42658 - DNA, 332 bp, Homo sapiens
  misc_feature 6, 15, 27: n = A,T,C or G
cgtatnactcgcatnggagtatcaatnacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggctttcgaagccgccgcctgatactggcatttgggag

SEQ ID NO: 42659 - DNA, 473 bp, Homo sapiens
  misc_feature 10: n = A,T,C or G
gtctaaaatngcgtgtacgcaggatgcatttgaacaatattaactcacgatgatagagctttatttgatttcaaagggattgatttcaccgcaccaaagtcatctgatcattgtgatcagagtcgttgtcatcacatcatcacagcagctcacacttaacactcacagtgaggcaggcactgttctcagtgctttatgtcaggggtccccaaccctgggatcatggactggtgtctgtggtggtctgttaggaaccaggctgcatggcaagaggcaagcggtgggcaggcaagtgaaacttcatctgtatttactgctgttcctcattgcttgtattaccacctgagctcctcctcatgtcagagcagcagcagcagcagcagcattagattctcataggagcacaaatcctattgtgaactgtgcatgcaagggatcaaggttgcatgctccttatgagaatctaatgcctg

SEQ ID NO: 42660 - DNA, 462 bp, Homo sapiens
acaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgaattttggtcactaaaaaagaagaaaaggactaacaagcttcactttttatgaacaactattttgagaacatgcacaatagtatgtttttattacctg

SEQ ID NO: 42661 - DNA, 124 bp, Homo sapiens
ttccatttttttcagtaccttttgaaaacatgaccaaactcatacttcaaaaatatatatataatgaatgtgaggaatatgaaaaaactttctttgtctagcaaactttcaaaggtggttatta

SEQ ID NO: 42662 - DNA, 472 bp, Homo sapiens
cacccaaaaaaccccttctaccaaaagccaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaat

SEQ ID NO: 42663 - DNA, 329 bp, Homo sapiens
agaatgaaagttgggtaaattccccaaaattacttgatgacaaagatcatttgggagagattctttcaaaaatgcctactccctattcccatatcccagcctaagggaatgagtttaagtgggtctacagtgggtcctgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagcct

SEQ ID NO: 42664 - DNA, 196 bp, Homo sapiens
acctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcct

SEQ ID NO: 42665 - DNA, 447 bp, Homo sapiens
ggaaaatggaatgcagctactgcagctaataaaaaattttagatagcaattgttacaaccctatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaatgttttaaaagggtc

SEQ ID NO: 42666 - DNA, 377 bp, Homo sapiens
  misc_feature 375: n = A,T,C or G
aattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggacattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaattatanga

SEQ ID NO: 42667 - DNA, 273 bp, Homo sapiens
atgggaagaattgaatacttacatgttgataactaattacagtttttaaaagctctgataggtcaaacagaaccagcttacaggctccatttggcccactagcaactagatgtgacttatgctttaaatggtttatttttaatcacaataatgtaaaaataaataatttaagtatcagaattttaactaggccaggtagagaggattgagttttctattcaaatgtaggtaatgcagatacagtcagcgtatggaataaacagtggtattgag

SEQ ID NO: 42668 - DNA, 421 bp, Homo sapiens
gtctagcttagagcaggaattggcaaattatgaccctcaggccacatatagcctgcaaccacctgtttttgtaagaccgaaagctaagaatggtctcctccatatatgtttttctctatatttttaaataggtgaaaaagtatcaaaacaagaataatattgtacaacatgaaacatacatgaaattcaaatctcagtgtccttgaataaagttttattggaacccagccacactcatttgtttactattatctatggatgttttcataccaccacaacagaattgagtagtagcatcagagacagtatagcttgcaaagctgaaaatttttactgtctatcttattattaaaaaatattgccaacctctggtatggagagaggagtattgaatttgtcagaaatacattaagaaagagag

SEQ ID NO: 42669 - DNA, 472 bp, Homo sapiens
ggcgcgtcgctagctagtcgttctgaagcggcggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatggatgatttcgtagagtgtttgcttcggcagaaaacgatgagacgtgcaggtaccatcaggaagcagcgggataagctgataaaggaagggaaagtacacccctccacctcaccacattggcaagggggagcctcggccctgaacagagcagctgctgatatctggaggctgattttcctgttctctgttctccactggaaaggttgtttacgacaaacctccttg

SEQ ID NO: 42670 - DNA, 164 bp, Homo sapiens
agctagaaacagatctttgtataaaaagaatttaatatgatcaggaggcattgtagactaatacgaatgggcagattatccaggaaatatggttgagaaaattggctcatatctgagaattcttctctggaattttaaatccaagataattgttaagcatattt

SEQ ID NO: 42671 - DNA, 422 bp, Homo sapiens
gctggttattaagtgaaaagtcccgagtcctgttggcatttaacatcacagaaggaaatccccagaaatgctgatttctttgggatttccacatgccaaatgattttctgagcatcagcagaaaaggccctcaggtccatgcccttcctcctccatgactctggcccctgcctcaagcccctcccccaccttggacctgtttttcaaaaccaccagctgtccctagagtgtggcttcccgctcttccttgacaagggggcccaccctgggacttaggggagtttttacttgggtcttttagttggctttagtgtttcacccaagaccctcgacgtagtacttggttatcactgctggtcattcagtttacttgactttagacccttcatctggtagcaatgctgaatgctaatgcttgattg

SEQ ID NO: 42672 - DNA, 360 bp, Homo sapiens
atctgagaaggcttttccgctttcggcaaatggactttgaatttgctgcctggcagatgctctacctgttcacatccccacggagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgttaggcgttggtcttctgatagcaactttaatgtggttcatctctaacaagtatttagtgaaacgacagagcagagactatgatgtgggaatg

SEQ ID NO: 42673 - DNA, 111 bp, Homo sapiens
aacttgggaggctgaggcaggagaatctcttgaacccgggaggcagaggttgaagtgagccgagattgcgccactgcactccaatgtggtgacagagcaagactctgtccc

SEQ ID NO: 42674 - DNA, 198 bp, Homo sapiens
  misc_feature 14, 15: n = A,T,C or G
gaaaaatattagtnnagttaaggggatctgagagccaaatacaagattcaacgtaaaaatggaatccttgggctaggcgtggtggctcaggcctgtaatcccaggactttgggaggctgaggcaggcggatcacctgaccttaggagttcgagaccagtctggccaacatggtgaaaccccgtctccactaaaaatac

SEQ ID NO: 42675 - DNA, 412 bp, Homo sapiens
  misc_feature 12: n = A,T,C or G
tctcttaaattncataaatacatgaaaattaaacaactttctcctgagtgacttttgggtaaacatcaagatttaggcagaaataaaaaaaaattctttgaaataaatgaagacagagacaaaacataccaaaatctctgggatgcagcaaaagcagtgttaagaggaaagattacaatgctaagcacctcaatataaagatctcaaattaacaacccaacctcacacctaaagcaactagaacaaaaacaaactaaacccaaagctagtggaagaaatgaaataactgaaaccagagcataactaaatgaaactgagactcccaaaattatacaaaggttcagcaacatacaaagttggttctttgaaaggataaatgagattgataaactgcttgctacattaaaaaaga

SEQ ID NO: 42676 - DNA, 256 bp, Homo sapiens
gataaggcaggtatggtgacagctaaaatacaatcagacttccataaaagaggtgaagggagacgagaatgattatgattgtttaaagaggaacagatcacattgtgttgagaaaaccgacttagttgtcccaaaaggttttctgagcttgtttcggaaaggaagactggacttttagcaggtgaatatgacagcatgaagggtaagccaatatagaagaaacaatgtaagattacaaggggcattttcaggatat

SEQ ID NO: 42677 - DNA, 372 bp, Homo sapiens
atcatttttaagaacatactaaagcctgaaaagattattttgaaataatgctgtaaaaaaggtctttgtgcataaaaatttttctgtatttaaaaaagtatgtttaagacagattctcagaagttaaattagtttaaacagtataaacgttcttcccaaactgcttcccaaaagggttattcacctttacctgactataaatataagaaaattatttctctacacccttgccagaaacaaatggatgagtcacagaagaagaaaaagggattaaaaattttttctagctaatttagaaaataataaaaccttcacttttatgaatgggttgatgtaatttggggaggttttagtattatctgagctttcact

SEQ ID NO: 42678 - DNA, 462 bp, Homo sapiens
  misc_feature 28: n = A,T,C or G
atttctaaatactaataataaactcagnaaaaagagataaaaccatcttatttacaatagcataaaaaacttagaaataaatttaaacaaagaagtgaaagatctgtacacagaaaactacaaaacattgataacaatggaagaaacataaataaatggaaagatattccatgttcatggattggaagaattaatgttgttaaaatgttcatatttacccaaagtgatatgtagatataatgcaattcctatcaaaatccaatgacagttttcatagaaatagaaaaaaaaattctaaaattcatatggaaccacaaaagagggaggcattatattacctgctctcaatattgactacaaagctatggtaattaaaacagtatggtagtggcataaaaacagacacacagaccaatggagaatagagagtccagaagtaaacccaaacgcatacagtcaact

SEQ ID NO: 42679 - DNA, 366 bp, Homo sapiens
agcaaaataaattcgtagtacaacatttgcaacaaaactaggtgacaaaacattaatcccaaagtacaagcagttggggacgaaatacctgcaagacttgcatggtatgtgagagagagaaggaagcaatagtgtaacttctaacttgacctgagaacaggagaaccccaaatagccaactggtgttcactgggaagctcagtggcccaatttgagagcagcaactgaaggtggaaggtgttttgcccactctaacacctggtaagtgctaagagctcgagataggggggattagagggctgacctttgaactctcaaaattgacctgccagcactgccttctagtgctgggccctatgcttagga

SEQ ID NO: 42680 - DNA, 200 bp, Homo sapiens
atttgcagaaactttcaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtg

SEQ ID NO: 42681 - DNA, 243 bp, Homo sapiens
gggttaagccgacccctaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccac

SEQ ID NO: 42682 - DNA, 468 bp, Homo sapiens
gtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggggtatcacccttcctccctccccaggcaccactggaccaat

SEQ ID NO: 42683 - DNA, 192 bp, Homo sapiens
agcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttc

SEQ ID NO: 42684 - DNA, 433 bp, Homo sapiens
  misc_feature 5: n = A,T,C or G
gcagnacctgggggtgaacccagtcccgaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgctaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaaga

SEQ ID NO: 42685 - DNA, 334 bp, Homo sapiens
  misc_feature 292: n = A,T,C or G
gtgagtataattacttccctcctttttccctttccgtctctccgagttgtgtccctaaaggatcctgctgcaagaaatgagtgaatgaatgaagatattaagaattaaagtactgatgttaatgagagcatgggtgatgtggtttggattgcttgaggccaggagattgaaactagcctgggcaacatagtgagacaaaccttgtttcaaaaaaaataatatatatatatacacatacacacactaagtgaggtggtgtgtgcttgtagtcctagctgcttggaaggctganatgggaggattgtgcccaggtgacagagcgagacccagtctg

SEQ ID NO: 42686 - DNA, 444 bp, Homo sapiens
  misc_feature 14, 25: n = A,T,C or G
ataaattaaagatnatatgcacagnatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatga

SEQ ID NO: 42687 - DNA, 387 bp, Homo sapiens
aacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatgggagatgtcctctccactttatcccacgatatct

SEQ ID NO: 42688 - DNA, 239 bp, Homo sapiens
gggaggccaaggtgggcaggtcacttgaggtcaggagtttgagagcagcctggccaacatggcgaaaccccatctctacaaaaaatacaaaattagccaggtgtggtgtcacatgcctatagtcccagctactcaggaggctgagacaggagaaacacttgaacccaggaggcagaggttgcagtgagctgagatcgtgccactgcactctagcctgggcaacaaagtgagactgtctc

SEQ ID NO: 42689 - DNA, 406 bp, Homo sapiens
  misc_feature 7: n = A,T,C or G
gagcggnagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaat

SEQ ID NO: 42690 - DNA, 395 bp, Homo sapiens
gattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtcttt

SEQ ID NO: 42691 - DNA, 379 bp, Homo sapiens
gggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatga

SEQ ID NO: 42692 - DNA, 323 bp, Homo sapiens
  misc_feature 22: n = A,T,C or G
agcccagtgttgagcacccagnagccttcctgcagcagccccccttttctccccagccaacatctgcaactgtgaacagatttccatcttcagccttggtggttggaaagaaatgtaagtcacctttttttctggttggttctggggcagatgccaccaggctgcagaggcagtctgtgtctgtggggctcaccagggcatgagttctgctcccaggaaagagattcttgcaggattttgtctgtggttctaaggagacaagtaggtggcacacaaaaacagaaaatgaaagaacccatccctccaaaaccacacacacaaag

SEQ ID NO: 42693 - DNA, 447 bp, Homo sapiens
gcttttattcttgtctgttctgcctcactcccgagctctactgactcccaaaagagcgcccaagaagaaaatggccataagtggagtccctgtgctaggatttttcatcatagctgtgctgatgagcgctcaggaatcatggactatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagaga

SEQ ID NO: 42694 - DNA, 470 bp, Homo sapiens
ggacgctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagttt

SEQ ID NO: 42695 - DNA, 330 bp, Homo sapiens
  misc_feature 4: n = A,T,C or G
gatnagctcctaccacattggggaaataccagtgaatcatctctgcttcttcctaaatgtcacatcccttatttggctaagtcctagttgtagcccagttccatggaaaattccacctactcctcctttaaaaaagtgagaggtggcttttctttcaaagtaagtttcagtcgcaatatctaaaaagttggaaagcccaacctgtaaatgaagaaaaaatagctctgagctcatgagctcattttaagaacaccaaaggactcctcatagccctatttgtatgtcaagaatagaaattgtgaacaattcctaaaactacttttcattccc

SEQ ID NO: 42696 - DNA, 367 bp, Homo sapiens
  misc_feature 32, 73: n = A,T,C or G
ggacgcctcgttgggttttggaggccgtgaancagccgtttgagtttggctgcgggtggagaacgtttgtcangggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctct

SEQ ID NO: 42697 - DNA, 136 bp, Homo sapiens
ggaccaggggactcagaaggccaagcagaaatgaccatgaccataaagccgctagacagggatagaagcaggaggggacaatcaagttgagcctatatcaaatatcctaaaacgcatgaagaaaactaatttttac

SEQ ID NO: 42698 - DNA, 467 bp, Homo sapiens
atcacaatcttgctgaagttattcctggtcattctactgagaatcttcgtatttgcctcacaatactagaatctcagccagtcagaaagcaaagaattatgtgagcctgtatggaagagggaataccaagaaataaggcagatgaagttattttatttaatagtaacagcaacaacaacaataaggccaactgtctttgctcaagctgttaactcttctccgcttgtagctatagcaccacctggagggagagtgggaacgtgagtctggaattgaattattttattttctccgagaaaccactattagctaccattaagcagcaaaaactgtttaattcaaaagctatttctagtctgatatactgatggatgtggagaataattgtacactggatgagatttttgtggaaattgataccttaccttacttattggccagggaagccaatggaatattaatttgga

SEQ ID NO: 42699 - DNA, 306 bp, Homo sapiens
caattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtga

SEQ ID NO: 42700 - DNA, 490 bp, Homo sapiens
ggttactgcgcatcaatttagaggtatccttagctactcattctcccaactttcagggtcaaacttttactctgtgtgtttcttttatgtaccattgtgaatacctacaagctgcagatagaataaaactattctttatgtttttatggggactagaagcaagagaaaaatggagttgggggaaattaatttgtatactctactaacaacagtaatcaactacattgacatcattaactggtcattatgaatttttcctcttccagagaaccaagaaccttctcaagggacaaattactaaatatataactcttactaacaatgtataacaatttgggaagaagttatgtaatctcaaagaaagtgctaactactcatttgttaacttgtatagaaacttctgttattcaacgtagtccttttattcctaaatggataagcattaaaagagatttgtcttaatttactttcaaaaacttctttaattagc

SEQ ID NO: 42701 - DNA, 438 bp, Homo sapiens
  misc_feature 21: n = A,T,C or G
gctctctccggtccgtgcctncaagcatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgta

SEQ ID NO: 42702 - DNA, 226 bp, Homo sapiens
gggggcagatcacgaggtcaggagttcgaaaccggctgaccaacatggtgaaaccccgtctctactaaaaatacaaaaattagccagatgtggtggcgcacacctgtaatcccagctactcaggaggctgaggcaggagaattgcttgaaccccggaggcagaggttgcagtgagccgagatcgcaccgctgcactccagcctgggcaacagagtgagactctgtc

SEQ ID NO: 42703 - DNA, 239 bp, Homo sapiens
gaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctatcgatttca

SEQ ID NO: 42704 - DNA, 392 bp, Homo sapiens
gctttcgctcaggcccgtggcgccgacaggtatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgaatgaagttctggttgctggatttggtcgcaaaggtcatgctgttggtgatattcctggagtccgcttt

SEQ ID NO: 42705 - DNA, 100 bp, Homo sapiens
ggtggatttgcaaagtaaatatttcaataagaaaaaagcgagatctttggtgaccctctcggttctgcttctatggcggtattttctatgtctggcagca

SEQ ID NO: 42706 - DNA, 466 bp, Homo sapiens
  misc_feature 31: n = A,T,C or G
tgtacaaagtagttgttctgactgaagtttnctgtcccataggatgaggatttgggcagtgggataaagcagctgcttcagtagacgagtagcttttccctcttctaatgtttatgctgcttccatttctgcaatgtgaccttaacaaacatgacatctgttgaatagtttcagcatgcatttccagatggtcattaagaggatagagattagtctctaataaaaataaaattatttaaaggatattgtttgtggaacaaagatactggtgtttatgaaatgaatatgaaagcctttgaaagtctacaaataaactaataaaatctatgtggattggtgacatttaaatacacctagaatgtgtaaatgcatctttacatcacaggaatattctaaaatattgaaaactacacagaatgatctttgggaaaacttggttccagctcttgctctgaaattgacttat

SEQ ID NO: 42707 - DNA, 191 bp, Homo sapiens
  misc_feature 31: n = A,T,C or G
gcgctcttcggcaccttttcctgtctcaggnatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtact

SEQ ID NO: 42708 - DNA, 346 bp, Homo sapiens
gcttttccggcggtgacgacctacgcacacgagtaacatgcctctcgcaaaggatctccttcatccctctccagaagaggagaggaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 42709 - DNA, 160 bp, Homo sapiens
  misc_feature 109: n = A,T,C or G
atatataaatatatatatatatacttctatttgtgggtactttaggaaaatgccctttggtcactgtaaatatgaattgtgaccccatcccttcccgcatgagcccagngagtcccagcagctatcagcctccctgaacgattaaacagctcctcccagc

SEQ ID NO: 42710 - DNA, 433 bp, Homo sapiens
gttttgagactgtttatttttgctcctcaaattttggctaggtgggcaaattcagtgtagtgtagagattttgtagtagagaaattgaaagtgtttagaaacagaaattatttatggatttaatcatttgtgaagtggatagatgaccatcttcccccctttttttggtttctgtgttcttaaagtctgctaatcccagcctcgaactgttcttatgtagttcatagtttatatgttcttcacaataaaagagattgatgagattagatgaatgaaataaagaaactttgatcattaacacaatttaaaatcaaaggtctttatacctgggaattaagaaaagaaaaatttttactaaaaactgttaaataaaaggggaaatataatctgaatgttacagaactaaaaaataattatgaagaaaacacttcat

SEQ ID NO: 42711 - DNA, 455 bp, Homo sapiens
  misc_feature 33: n = A,T,C or G
ctttttgaggaagacgcggtcgtaagggctgangatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttga

SEQ ID NO: 42712 - DNA, 118 bp, Homo sapiens
  misc_feature 41: n = A,T,C or G
gttaacatacccttagtatctgtgtatgtattgtgcccagnattatacacataccactgtaataatatgctatgtatatttttaaacatacaaaaataaacattttaccagagtgaag

SEQ ID NO: 42713 - DNA, 405 bp, Homo sapiens
gggcgcggtggcgcgtgcctgtagtctcagcctcccgtgtagctggtattacaggtgcccaccaccatgcctggctaatttttgttaaattctcttttccaaagatgcgatactattattctgttgcagcaacaaaaactgggtatacacacaaaataattgaaaacatgatatttatacatctaggctcatgtcagcattattcacaacaggcaaaagatggaagcaatccagatgttcattggaaaaataaaatatggtgtgtacagacactggaatgttattcagctgtaaaaaggcatgatattctgatacatgctatggcatcaaagatcattgagaacattatgctaagtaatataagtcagacacgggaaaacacatgttttgtgattttaattatat

SEQ ID NO: 42714 - DNA, 384 bp, Homo sapiens
gctcttcctttctccgcctcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatattgtaaggcctttctttct

SEQ ID NO: 42715 - DNA, 120 bp, Homo sapiens
aatgaaaataagctctttttaatgatgtcactgtttgcaagagtctgattctttaagtatattaatctctttgtaatctcttctgaaatcattgtaaagaaataaaaatattgaactcag

SEQ ID NO: 42716 - DNA, 465 bp, Homo sapiens
aacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatgggagatgtttctttttctgtcttctagactaaatagagtatcatccaaataatggggcctatg

SEQ ID NO: 42717 - DNA, 424 bp, Homo sapiens
gaaattcagaattaatacttaaactgtgtatgttaaacaggttttctgcagattgcatttggtgttcttcatttactcagtaggtccaatgttaatacggagatagaattaccctttagcatttgagaagggggccagttaagggcttaggtgcaagggatgcattacacttacaaccttctatctttggtgtatgagaaatagttcaatcatagcatcatcagatgaattaaataattcatcctgctcactctcctgccttcaggctagactgcaactcaactgttttaatgtaatatgggaaggatggaggggccaggaagataaggtaggaggaaaatggacatttcatagattctaatttgattctctgatagtcccacataaggaaatatttcgttatatctaatctaaatatttatgc

SEQ ID NO: 42718 - DNA, 491 bp, Homo sapiens
  misc_feature 5, 7, 33: n = A,T,C or G
gatancncggtttgtatagcagatttctacagnttttgatgctttcctcatatccatggcgcattcaactcaacttattgatggctgctcgttgataaagctggagacactatgcctgaaggttcctccccaaccccccaccatcatgcccacacaaagggcagttcagaagtgctggaaattgtccttggaaacagccctcaaccaatgtcagaaagagctggtggataaatatcccaactttctcactcattttttgagataaatcaaaaaatggggtatactttacactctccctgagttccccagtaggataaaattctggttgtccacagtagaaatggcttgattaagtattctcgactggcttccttcccatttttttctcacttacttattcctccatgtgtattccatgggatcacctctgtgataaactacttgccactgaatatttgtctcaggggctgcttatgagggagcccagacca

SEQ ID NO: 42719 - DNA, 150 bp, Homo sapiens
gaccgggggtatactacggtcaatgctctgaaatctgtggagcaaaccacagttttcatgcccatcgtcctagaattaattcccctaaaaatctttgaaatagggcccgtatttaccctatagcaccccctctaccccctctagagccta

SEQ ID NO: 42720 - DNA, 397 bp, Homo sapiens
  misc_feature 34: n = A,T,C or G
gaaacacgtgcaaaagatgccacaaatgtggcancagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaat

SEQ ID NO: 42721 - DNA, 235 bp, Homo sapiens
aggggcagattgacacctcacacggctgggtacccctctgagacgaagcttccagaggaacaatcaggcaggaacatttgctgttcagcaatattcgctgttctgcagcctctgctgctgatacccaggcaaacagggtctggagtggacctccagcaaactccaacagacctgcagctgagggtcctgactgttagaaggaaaactaacaaacataaaagtcaaccacaccaca

SEQ ID NO: 42722 - DNA, 206 bp, Homo sapiens
tgtgcttcctggcagtggtattaacaagtaacaaggacaagtgaatgatgagagagccagagaagcaaaaggcagagggaatatcttttaaaatggaaagttaagccccaaataatgaagttttcactactggaataaatgattatgtttgtagcagcaaaaaatcaagtttagggacatttggctggtttttgatgattgtgtat

SEQ ID NO: 42723 - DNA, 284 bp, Homo sapiens
ggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtta

SEQ ID NO: 42724 - DNA, 255 bp, Homo sapiens
aagatgggtcaccagcagctgtactggagcccccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 42725 - DNA, 108 bp, Homo sapiens
gggaggctaaggcaggagaatcacttgaacccagaaggtggaggttgcagtgagctgagattgtgccattgctctccagcctgggagatgagagtgaaactctgtctg

SEQ ID NO: 42726 - DNA, 137 bp, Homo sapiens
  misc_feature 24: n = A,T,C or G
agcaggtcactatgccatgatganaggagttttaggggaatgggaggaaacagaagcagaagcctgtaaaccagttggtgtgaatgggtgaggggccatggggtacagaattgaagacttctcaagatacgtggtgg

SEQ ID NO: 42727 - DNA, 324 bp, Homo sapiens
gatggctcaacatatgaaaatcagtcaatgtaatgtgccacattaacaaaataaggaacaaaaactacatgatcatctcaattgatgcagaaaaagcatttgacaaaatttaacatcctttcatgataaaaacaatcaataaactatgaatagagggaaactatctcaacacgataaaagccatacacgaaaagcccacagttaataccatatgcaactaggaactactgtttttcctctatgatcaggaacaaagcaaagatgcccatccttaccactactattcaacatagtactgaaatttccagccagagcaattaagat

SEQ ID NO: 42728 - DNA, 490 bp, Homo sapiens
  misc_feature 32, 34: n = A,T,C or G
aacatcccaattgctgcaactgaagaactgcntncaagcaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatc

SEQ ID NO: 42729 - DNA, 172 bp, Homo sapiens
atatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagc

SEQ ID NO: 42730 - DNA, 365 bp, Homo sapiens
caccctggtatttacagccttgatatcttgaaacagaatcactatgattctttggcattttatcactggagctaccagttttggtagaagtgtcagtggtaatttgtagttttaatttataggcatggatttctttagagaattcaagcagagatctcaccatgtcaaggaaccacaaatatgctaaagtggacagtgagtccattataaccatcttggggtgaaaatcaatcatggtttgttaagtgctttcagaagttgttgttgctgttttaatttccatgactcaatatattgtgtagaatatattcagtagggtaattttggatttatgtgtttatctcccgttagattaaactagaatg

SEQ ID NO: 42731 - DNA, 218 bp, Homo sapiens
agatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttttcaacttg

SEQ ID NO: 42732 - DNA, 294 bp, Homo sapiens
  misc_feature 24: n = A,T,C or G
attgtcactcatttacgtaaaagnaatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaagggaaagttatttttcagacatatttgaatgactgctgtactg

SEQ ID NO: 42733 - DNA, 183 bp, Homo sapiens
ggagcaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaac

SEQ ID NO: 42734 - DNA, 386 bp, Homo sapiens
  misc_feature 15, 24: n = A,T,C or G
caatgagtccctggnaacgccagnatgcgtgaaatggaagagaactttgccgttgaagctgctaactaccaagacactattggccgcctgcaggatgagattcagaatatgaaggaggaaatggttcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatga

SEQ ID NO: 42735 - DNA, 128 bp, Homo sapiens
attgtcctcattgcatgtgtagtttgagcacagtatcccaaaccttacggccaagtttcttctagtatgatggaaagtttcttttttctttgctctgaataaaactgaactgtgggttctctataagt

SEQ ID NO: 42736 - DNA, 211 bp, Homo sapiens
  misc_feature 19: n = A,T,C or G
ggctctaccccctgaaaanggtggatgcatctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttact

SEQ ID NO: 42737 - DNA, 424 bp, Homo sapiens
  misc_feature 1, 7, 32, 49: n = A,T,C or G
naagganccctgtgctgatctgccggaagatngaacttggaatggcagngcaccatcctgcatttcaattgaatgtgacttgcctactgctcctgaaaatggctttttgcgttttacagagactaagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactg

SEQ ID NO: 42738 - DNA, 182 bp, Homo sapiens
  misc_feature 31: n = A,T,C or G
cttccttggataggtaaaactgtagtgacanaggacagattagtggttattagtgggtaggggtgataggtgtgatcataaaggataatgcaagatagtttttggggcagagttgttctgtatcttgattatggtggtggctatacaaattgacacgtatactaacattcgtagaactttac

SEQ ID NO: 42739 - DNA, 254 bp, Homo sapiens
gatcattcggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacacttattgaatgaaaaatgcactcttgtttttccatttttttaaataataaaaatcagacaag

SEQ ID NO: 42740 - DNA, 265 bp, Homo sapiens
ctgtctcaaactgttttccctgcagcacccaaggctctgtcatgtctcaaacatttaatcattaatttaaaaagagaagcttatcacagaattagaaaaaaaaatttgaaaattcatatggatccaaaaaagaggttgtgtagccaggagaatgctaagcaaaaagaataaagctggaggcatcaggctatcctacttaaaactatactataaggctaaagtaaccaaaacagcatggtactggtagaaaaacaagcatatagac

SEQ ID NO: 42741 - DNA, 403 bp, Homo sapiens
  misc_feature 7: n = A,T,C or G
aagacanggaaaggcatccctcctgaccgcataggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaagtggagccgagtgacaccatcgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccat

SEQ ID NO: 42742 - DNA, 424 bp, Homo sapiens
  misc_feature 360: n = A,T,C or G
ctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcanaaacagattctcagttcatttttactcccactgtattatagtttaacaaaaattgtttatcttg

SEQ ID NO: 42743 - DNA, 101 bp, Homo sapiens
gaaaaaagatacattacaactgttgccacagtaaatacaagaaatcatcagagactattatgaacaactataactaacactaacaaactaaaaaatctagc

SEQ ID NO: 42744 - DNA, 384 bp, Homo sapiens
  misc_feature 33: n = A,T,C or G
aaaagcacaggctttttccaccggcatcatcantgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattggtacacacagaggggaaccgattttttttatccaatgtgaattataaatgaga

SEQ ID NO: 42745 - DNA, 280 bp, Homo sapiens
  misc_feature 33: n = A,T,C or G
gttcatgatttaaaaaaaataccatgagaatcnttttaccaagtaatttactttatacaaataattagaaattatgctatcactaaaacatagtttaaatatttttgaaaataacttagtgttgtcataaaatagaattggaaaaggcgggtaaatcaacataattggtaactggcaaaagtttcaagcattctgcctaagaactggagcaagacaaggatgcccgttcttaccactcctattcaatttagtactggaagtcttaaccagagcaatcagg

SEQ ID NO: 42746 - DNA, 306 bp, Homo sapiens
ggcaaatgccccatgcccagctaattttgtgtttttagtagagactgggtttcaccatgttggccaggctggtcttgaactcctgacctcaggtgatccaaccgcctcagcctcccaaagtgttgagattacaggtatgagccactgcacacagccacactttgtatcattgtacatagccttaaactatcatactaagtaactgaagaaaaaggtgctaattgaagttgacaaatatagtaggcagaaatggagtttgatttacatagtaggaactataggataagaaccacagctgttaaccta

SEQ ID NO: 42747 - DNA, 142 bp, Homo sapiens
aagagctgtacatggtggcttatgcctgtaatcccagctattcctgaggctgaggctggaagatcacttgagcctggaagatcacttgagcctgggagttggagaccagcctcggcaacgtagtgagaccatgtctcttttc

SEQ ID NO: 42748 - DNA, 355 bp, Homo sapiens
caactgaaaataaataagccctcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctca

SEQ ID NO: 42749 - DNA, 429 bp, Homo sapiens
  misc_feature 32: n = A,T,C or G
gcaccttggaacgccatgaagttttctgcatnatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactg

SEQ ID NO: 42750 - DNA, 203 bp, Homo sapiens
  misc_feature 7: n = A,T,C or G
aatgatncctatggtttctaaaattctttttgtctaaaatcatgaagatggcagatgcacaaaataatacatctctgggctgtgtgtggtggttcacacctgtaatcccaacactttaggaggctgaggcaggaggattactggaggccaggagttcaggaacagcctggcaacaaagtgagaccccatctctgcacacatac

SEQ ID NO: 42751 - DNA, 257 bp, Homo sapiens
  misc_feature 34: n = A,T,C or G
gtttgtcctcctggtactcatgtatttttttttncgatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattac

SEQ ID NO: 42752 - DNA, 354 bp, Homo sapiens
  misc_feature 6: n = A,T,C or G
gaagcnatggagctcctcactggactcgcctttctcctctcctccccgcaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattg

SEQ ID NO: 42753 - DNA, 471 bp, Homo sapiens
ggacccccaagctcttctaaaacaatttgatctcctaaaccacttgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatat

SEQ ID NO: 42754 - DNA, 119 bp, Homo sapiens
aggagcccaagttgtagtacactttaagtgaatttatatatacacagaatagttttcaaaaggtcagatgataacatatgtttgtacttgtgaaattttgcaagacagcatttgagagc

SEQ ID NO: 42755 - DNA, 466 bp, Homo sapiens
  misc_feature 31: n = A,T,C or G
aaatatcaattctttaatctcctaccaactntactaagtagcagttattatctctattttacaaataaggaaaccaaggcatggagaggctaactaccttatccagggtcacgcagtcattatctggctaagctgggatttgaacccaggggatttggctctagcatctgtactcctggccactacattgtgctgatgcttctgatgactcctgttataggatattctcatttttttctttgtgttagaaagaaaagcatgtaaaacataactaatgaaggtataatagatagaatgacatgccataggaggtagggactctgtgtgtccttcatgacactggctgcactggggagtaaatgtccccattactcaggtgcatctatgaagcagaaagggcatgcatttgctatcaagattgtaaagatgaagaaattgaggctcaaagtggtgaagtcatctgccc

SEQ ID NO: 42756 - DNA, 465 bp, Homo sapiens
  misc_feature 34: n = A,T,C or G
ggaccatgtacttaagagttagtgtatatgcgtnatgtcaattgagattggctttgaactttgtctgggtggggttagaaagttgagactgcatcatcatgcagatatctttttaatatgtttagctcagacttttcttcagagacttgtgtaagtaggctgtggtctttgcagtcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaaggtaggagacatctcccatctaaacatcacagctggttctatgtttttgccttctttcatctctcactgaccttaaataaacagtctaaag

SEQ ID NO: 42757 - DNA, 444 bp, Homo sapiens
  misc_feature 31: n = A,T,C or G
gcaactcggtggtggccctgcgcagaccttncttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaag

SEQ ID NO: 42758 - DNA, 414 bp, Homo sapiens
  misc_feature 6, 32: n = A,T,C or G
aatcancagcaatccgaaattttttggccctngatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgccttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataaga

SEQ ID NO: 42759 - DNA, 409 bp, Homo sapiens
  misc_feature 32: n = A,T,C or G
agtccacatagttatgagactgaacacctganttaatagatgttccataagaagaactagggaaacaccatgttatacaagcaaccttaggaggtatttaacccagtcctctcaatccacagataaggaaactgagttcagagatgtgaagtgacttgcccaagattgtgaccgttcatagcaaagctggacctataagctatgtttacatctgagccatgagtagctagttctagtctagttgtaaactaaaattcaaaggaaaaacaaaagccctcacctattttatactttgttgggtgtttgtctgatggatctgtgaagtgtggaaggcagggaagcattgggttagagccccagatgtagcgttttccttgatataagccactgctgtcatttaagcgattat

SEQ ID NO: 42760 - DNA, 467 bp, Homo sapiens
  misc_feature 28: n = A,T,C or G
aagctttgtcgtttgagatttgcacagnaatggggggagtagattacctcttcccattcattgtcataatggatctacatcactgataaacaccatacttctatatgtggttaactagctttagaataaaagacactttaaaaagtaaaaggcctagagatcttcaatgaagtgtcccttttagccaaaccaggccttgcagaaattgtcctcaaaagcaccaagggagaacaaagccaagtgcagaattacccaagggtcacacattttgtattcattttcttataatttgcccaaatgatttgaagtacagcaaaacctgaagttttgcaaagagttactgtaaactgaacttaaaaatgtcagagtgctcggtgacccacttctccagaccctgtcaacctgtgaaaatattggcctttattcagatctctcaagaagttacgtgcagagtttgggaaggtcta

SEQ ID NO: 42761 - DNA, 449 bp, Homo sapiens
aggaatgtggccctgagtgtaaaagattttgatttttcaggagtaggcaaaatctagaatatgtgtaatgatccttcaatttttcatcattgacaactaattcagtttttctaaaaagcacaaaaactcattaaaggtctgtacattttatcataggtaaattatatcataattttaaaaatgtataggttaaatgatgatctttatatgcctaagagttactggatatgttaaaaaaatatatgatagtaaaactataaggcaagaaaaacttaccttataaagttggctcaagggaagtctggagcacatattaagattgagaaaactgaaaaatgaagtacttaaattgaccataactgtgagagcctttgaaatccttaatgaattaaaatgactaaggattttctgaaggctttttaaattgtatataattgcagcagtgaaga

SEQ ID NO: 42762 - DNA, 343 bp, Homo sapiens
ggcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgcacataacctaaacctactccaatgctaaaactaatcgtcccaacaattatattactaccactgacatgactttcc

SEQ ID NO: 42763 - DNA, 430 bp, Homo sapiens
  misc_feature 32: n = A,T,C or G
gggaactgcgtgggctgccgggctggcccatnttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtg

SEQ ID NO: 42764 - DNA, 398 bp, Homo sapiens
aacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatga

SEQ ID NO: 42765 - DNA, 264 bp, Homo sapiens
  misc_feature 22: n = A,T,C or G
agaagcggtgcatacctcagancctggataaataacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactg

SEQ ID NO: 42766 - DNA, 443 bp, Homo sapiens
atcttccgtaccgtacctgggagggctgagtccacgaggcgctcgtgctcactcactctccatttgtgcttctagctgctgacctctggagtgaatttttctgcagaaatccttggctgctccccatgtgtgcacctgaagagttatagaaagccctgttcacgtttctttcacacatgtcctttatgtcatgggcaacctgtgttcattgaaattttatgatttctttgtatcacgtgtgtataattttcactgtacaagaaacttatatacttaaaacatcttccagtgttaggcctggtgcgatggctcatgcgtgtaatcccagcactttgggagacgaaggcaggtggatctcctgaggtcaggagtttgagactagcctgaccaatatgatgaaaccctgtctctactaaaaatacaaaaatcagccgggcatggtg

SEQ ID NO: 42767 - DNA, 207 bp, Homo sapiens
  misc_feature 8: n = A,T,C or G
aaggtaanaaggaggtgggaaaaattttaaaacttgagggtaaaaatgtggaaaacaaaccctcccatcccttgtagattgtaaataaaagcaaaaccgccacagaactagaggtcttctctttaatgttactttaaaattgctatgattgtattgtacgttatttaatgtctgattgaaacacaaatttacatgcatgtttgttac

SEQ ID NO: 42768 - DNA, 432 bp, Homo sapiens
  misc_feature 7, 23: n = A,T,C or G
aaacctntttttttaggcccagnattgtaaatattttagtttttccagttaactagaaatatcagtactattatttaggtatttatataatgagaggaaactttaattgacaaaatttaagatataatgattgagtacaacttaattgaagttcaaggttgctattccttgtcatcaaaattgactgtaaatgttcatctgttaatgctgatttgtaatgagattttatgtattttatctttgaaaagaaattttttaaacaaataggtcctatgaaatactgatactaatccataagcaaatgattttaattgtgaatatcaatgagttgaaagatgtggtaaactgaatagtggctccctaaagatgtccatatcctaattcccagagcttatgaatgttacttcacatggtatgagatatttactggtg

SEQ ID NO: 42769 - DNA, 172 bp, Homo sapiens
catatctgttgaaacactcttgaatctccagtaataaagactactttattatgggaaattaactttttgatgtgctgttggattcagttttctagtattttgttgaggattttgcatttgtgttcattaggatattggcctgtagttctctgcttttttttgtttttttttt

SEQ ID NO: 42770 - DNA, 381 bp, Homo sapiens
gaatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagag

SEQ ID NO: 42771 - DNA, 116 bp, Homo sapiens
ggaaggccagaggaaacctggagcttaggcctgggggagcccatccaggaacatgcagtcccagcagaccaggctcctgagaagaactttcagccaataaagcttgtgcttccccc

SEQ ID NO: 42772 - DNA, 453 bp, Homo sapiens
  misc_feature 35: n = A,T,C or G
agaaattcgaacttttaaaattttgaaatgtttangaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacgttccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagat

SEQ ID NO: 42773 - DNA, 178 bp, Homo sapiens
  misc_feature 7: n = A,T,C or G
gggaatnagaggaggaagcggctggcaactgtggctggaacacttgctactggataatcgtagcttttaatgttgcgcctcttcaggttcttaagggattctccgttttggttccattttgtacacgtttggaaaataatctgcagaaacgagctgtgcttgcaaagacttcatagtt

SEQ ID NO: 42774 - DNA, 332 bp, Homo sapiens
  misc_feature 32: n = A,T,C or G
gaaacccttgtggaattgcctcagcagccagntaccccactgtgtgagctagtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttgcctgtttaaataaaatttaatttcaaatac

SEQ ID NO: 42775 - DNA, 240 bp, Homo sapiens
  misc_feature 1, 24: n = A,T,C or G
nataagaagaaatctgcacaaagnaacacgaatatacaatttacaaaggagtttaaggacaactggaaaacattggaaaatgttcatcactactaatcaaagaaatgtaaattaaaaccattaggtaagcctctttttttgagacagaatctcggctctgtcatccaggcggaggttgcggagagccgagatcgtgccactgcacaccagcctgggtgacagagtgagactgtgtctcag

SEQ ID NO: 42776 - DNA, 447 bp, Homo sapiens
  misc_feature 7: n = A,T,C or G
cagaggngacagtctggttcctgggcataattctccaaaaacaacagggaaataactataaatataggttaacatttattgaatgcctaccttgtgctaggtgctgtgctgagtatttgtattgacacatttaatctttgcaatgattctatgaaataaaggtattatttccattttacagatgaggaaactgaggaatagaggggttaagaaatctcatatcacacagtatattagcagagtttgaatatgaaccatagcagtctggctccagagccctctttctcaagcactatgcaatattgccttacaaaaaaccaattaaggatagatctctgaaggcttagctatcttgatttcactacagctcagtagcagttcagtgctttggctttggagtcacagccaagttcaagtcatggttgtgtgactttggattttattaac

SEQ ID NO: 42777 - DNA, 476 bp, Homo sapiens
  misc_feature 8: n = A,T,C or G
ggagaccncagcgactttaggctggataatatttaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacggtg

SEQ ID NO: 42778 - DNA, 140 bp, Homo sapiens
  misc_feature 32: n = A,T,C or G
ggatatagttataatctgatgggcctggctgngagtggaagaagggaagccttttgcaaatagtagagtgtcagttgcaggtgccaatgactaactttttgaattctatgttggcattaacaataaagcattttgcaaac

SEQ ID NO: 42779 - DNA, 490 bp, Homo sapiens
  misc_feature 24, 34: n = A,T,C or G
aatgtcaagggcagccagaaaagnaaaggtcttnttacccacaaagggaagcccatcagactaacagcagatctctgcagaagccctacaagccagaagagagtggaggtcaacattcaacattcttaaagaaaagaactttcaacccagaatttcatatccagccaaactaagcttcataagtgaaggagaaataaaaccctttacagacaagcaaatgctgagggattttgtcactaccaggcctgccttacaagagctcctgaaggaagcactaaatatggaaaggaaaaaccactaccagcaactgcaaaaacatatgaaaatgtaaagaccatcaacactatgaagtaaccgcatcaactaacgggcaaaataaccagctagcatcataacgacaggatcaaattcacatgtaacaatattaaccttaaatgcaatttgggtaaatgccccaattaaaagacacagactggcaaattgaataaag

SEQ ID NO: 42780 - DNA, 333 bp, Homo sapiens
aagcctggaagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggtaga

SEQ ID NO: 42781 - DNA, 348 bp, Homo sapiens
  misc_feature 13: n = A,T,C or G
ggaatcttatgtnagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttg

SEQ ID NO: 42782 - DNA, 183 bp, Homo sapiens
  misc_feature 32: n = A,T,C or G
ctcgaactcctggcctcaagcgatcctcccanctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtg

SEQ ID NO: 42783 - DNA, 307 bp, Homo sapiens
tggatacggttttggatgaccttgagaaattaaatggaataacagaaggagaaaaacaggtataaaaggtctaagaattgggacgactcaggatatctgattagagagtgcctaaggagattcagcatagtcctgcccgcaaagattatttatttacttcaagagttaagagtggcagtttggggatagcaccaggagatatcagctgtgatggcttggaaaaacagtgtaaaccggcagtgtaaacaagagcagggcgtgtatgagtagttgagaacggtgaataggagtatgactagacagaaga

SEQ ID NO: 42784 - DNA, 100 bp, Homo sapiens
caggagaagttggataaagaggtatttgtgaactgcgtactattttttcaacttctctggaaagttatttcgaaataaaaagtttcttaaatttactttc

SEQ ID NO: 42785 - DNA, 385 bp, Homo sapiens
cagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataaatagggtacctgggatttatgcaaatgtcttttctgcgtcttttgagatga

SEQ ID NO: 42786 - DNA, 195 bp, Homo sapiens
cgcggtggcgcgtgcctgtagtctcagcctcccaaaatgctgagattacaggcatgagccactgtacccagcctttccttataaaattcaaagagaaaatttctacacctttatccctcaaataaaacaagtgctcagttcttaccgtgcccttgcaaggtctatatgtaaaagaaatctgaaatttagctgtgg

SEQ ID NO: 42787 - DNA, 332 bp, Homo sapiens
  misc_feature 302: n = A,T,C or G
gttctctgcagtgggagcagctctcctgcccagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtnggctgggttctggggctgggattggaactg

SEQ ID NO: 42788 - DNA, 325 bp, Homo sapiens
cggaaaaaaggaacctttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgt

SEQ ID NO: 42789 - DNA, 407 bp, Homo sapiens
agaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggctttttctg

SEQ ID NO: 42790 - DNA, 459 bp, Homo sapiens
accacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggttt

SEQ ID NO: 42791 - DNA, 264 bp, Homo sapiens
cggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttagtttgtctg

SEQ ID NO: 42792 - DNA, 292 bp, Homo sapiens; identical to SEQ ID NO: 39194

SEQ ID NO: 42793 - DNA, 102 bp, Homo sapiens
  misc_feature 2: n = A,T,C or G
anatttttaatgtttttattaaccttttgattttgtctcctgtgaagtgtctatcatcttttgcccattttttaacttgttgtctttttctttttcttttct

SEQ ID NO: 42794 - DNA, 178 bp, Homo sapiens
gagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagccgg

SEQ ID NO: 42795 - DNA, 470 bp, Homo sapiens
  misc_feature 3: n = A,T,C or G
aantcaggatctgcagtttctcacaatcttcggtgatttctctggtccttaaagtttgaaaagctgcctcgaaacagtccttcctaaaactgaagtggaggtgccacaaaaatcatctggtaaattgtttaaagtaatcccaaatgcaactcaaatctacagaatcccaggtgaagctcagtaatctgtatttttatccttctccccaaataattctgatgtgcaggcaagtttgaaaaccactgctttaaagaaaatggatactccccttaccaagcagaaagtaggattttggaaactgatgcaagggaagcaaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatgggagaaccaaagaacc

SEQ ID NO: 42796 - DNA, 466 bp, Homo sapiens
caggagactaataagcagcccccccagtcggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactgcactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaaagatggtagcagcaaaagtaaagggtgagaaactggataagaagctg

SEQ ID NO: 42797 - DNA, 310 bp, Homo sapiens
  misc_feature 1, 2, 178: n = A,T,C or G
nnttcttaatgtctcagtacttacagtgtaaggaaatcctatgaaggagtgaaaataaaaagttgtggtttactcaaaagttttagagaagctttacctacacgttttagaaaaaaggaagggagttgaagagagctgagctctgtagccaatgctttcctatagaataataccttangagtactattaccttagagttttaaggaaggagaatactaactaactataaaccattatgtagatatttataacatggaatgctaaaatgatcaaggggctaaactttcactgcccaaacataacacaaaat

SEQ ID NO: 42798 - DNA, 115 bp, Homo sapiens
  misc_feature 1, 3, 16, 20, 24, 27, 58, 73, 106: n = A,T,C or G
nanactttaaggtganacanccgnatnattttagggttcgaaatgtgagtgggaaatntgcctactagctgtnggcggctgattactccattcccaacatgcctangttctcgac

SEQ ID NO: 42799 - DNA, 307 bp, Homo sapiens
tatatttggtagaaaaataagtctctttgagattcaatggaaggccttttctatggttagttgaaaggtcattttagattttgctttctttagtcaagcagagattaccagatttgggtacaaaaaatatcagctcacagattgttctctgtgctgattttacagcagttactaaattccaacgaatgcattgtttaggccctttgaaccgaagcaaataaaaccacagtgcacacacactaaacaatagggcatcatcaattagccatctacaggatgtgtccttgcagactggcccctttgtagg

SEQ ID NO: 42800 - DNA, 428 bp, Homo sapiens
  misc_feature 4: n = A,T,C or G
agtnaacagtggattcctggagttatgaaaaagaagcaagggttttctgcccctttggaagaacagaatatctgctagatagcctctcaagatgagaagtgaacctggagattgctcaccagctgctttcttgaagccaaagctatattaattacagtattttctcatgtcatctttggcctatgagcttgggtatctagttcatctaaataatccaaccaagagttgtttccttacgcattacctggagttaatttgagaaccagtatacaatacttgagtttgataagaatttcccagtctaattttttttcttccctctcattccaataatagaggaattatatcattctcacaggcccagtgaaaaaatgaatgacacacagcgtttattgctttctaggtcttgttgcctttaagagaagaat

SEQ ID NO: 42801 - DNA, 362 bp, Homo sapiens
aagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgtttgatggcagtgccagcaattattgctaatccgtttgcatccttatgcatagatctgaattcagactttgtgaatttccagaggtgtgggtaatataatag

SEQ ID NO: 42802 - DNA, 464 bp, Homo sapiens
cagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcattggtggcatcacccataaagggaacacatttgacttttttttctcatattttaaattactgcaag

SEQ ID NO: 42803 - DNA, 482 bp, Homo sapiens
  misc_feature 24, 30, 36, 40, 46, 72, 87, 94, 113, 114, 123, 148, 160,170, 287: n = A,T,C or G
tgccccctaaagtcagggagtacncctganccaaantgcntagagngcactggggcccagggtaaaaaaatnggggccctagagtgnaagaccnggtgcctgtcgttaaaganncctttcgangaaagggagtaccttacctccccanctgactgatganctgggaaaanacttttcaggggagaattgaaggggttaaagtgttaaatatgttgcctagacaagggttctttaaagaaagacagcgcaactttgaatgctttcttacttgttttgtgacctaattncggggggaagaatggttatttcatttaggatttagtaaaattttttttttctgattctaaacttattgtgaaaattgagctgtacagatattctttttgatttcaattgggaacatttgggaagaacaacagtcttacttgcctgtacaatatagagacatatgaatagcataaccagttttcaacttgttcttg

SEQ ID NO: 42804 - DNA, 153 bp, Homo sapiens
  misc_feature 3, 32: n = A,T,C or G
aancgtcctagagcttaaggccctgtcttccncccctcctgacccgtatagtgtgccacaggacctgggtcggtctagaactctctcaggatgccttttctaccccatccctcacagcctcttgctgctaaaatagatgtttcatttttctgc

SEQ ID NO: 42805 - DNA, 469 bp, Homo sapiens
  misc_feature 105: n = A,T,C or G
accatttgcattgccgttactctgtgtccaagatgtcaggcagtaaagagcaaaataacaagcatttatgtacttgaagcaaataatgtatcaccatacaaatantattgatgtgcatatttcacatattcattgtgggacagatttaattagaagcttgtcaacaggatttttagctttttggggagtatgttttgtaccactgagtgcacatcttggctcttcaacctaattttcctctcatgttgtttgatcagttcctttttatactgtctttctcccttcacccttattatcatagattcttttaatcagctggttggaaataactctggaagccctgggacagttggaagcatgagccctgctgttggaggtagggaaaaagtgaaccataagtgaaccttaagagatgaattgtgaaccaaaggaatttggttcagagtatgcatttacttcagacccctta

SEQ ID NO: 42806 - DNA, 461 bp, Homo sapiens
gaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctcctcctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggggtctggacaaagtgcc

SEQ ID NO: 42807 - DNA, 276 bp, Homo sapiens
cattctcggaagagaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagt

SEQ ID NO: 42808 - DNA, 219 bp, Homo sapiens
caggctagtgacactactttacagggatttatagtagctaaacagtctagcacttatgaatatggattttggagtcagcctggtagctaaagtgcccttgcatgtaaactctctgagcctcagcttccatgtctacacaacagggataccatatcccctaccccatagggttgctgagaggagctgagataaagcaaataaagtgcttggaacagcttc

SEQ ID NO: 42809 - DNA, 470 bp, Homo sapiens
  misc_feature 316: n = A,T,C or G
gacctggctgaggctgatgacgagggtgagcctgaggagggaacttccaaagatgaagagggcagggccagccaggagggacccccaggtccagagtgaccccatccccatccccaggattcccacctcctagtgaatccagagttgtagtaaagcctaactgctgcaactctgtcatcctgtctgcgagatcacagacacaggagcgaattggtctgtagatgcccagctagagatataggagtttaacgcacattcagcccccacttaccagtacacacacacacacacacacacatttgctcatagacctgtnggccccaagactgtgcattccatctaaaatgctctggaatttccattctcagagcacacagcacacatgctttctcacaagcaccgatgtatcttacacccacataatatatacacattcagtcatgcacctcctaaacacacatatgctgaca

SEQ ID NO: 42810 - DNA, 119 bp, Homo sapiens
  misc_feature 108, 110, 118: n = A,T,C or G
catctggacatttaatgaaactgagagacagaggcttgtttgctttgccctcttttcctggtcacccccactccctacccctgactcatatatacttttttttttttncnttaaaganc

SEQ ID NO: 42811 - DNA, 408 bp, Homo sapiens
caattcaagcagtttaagattgccaagacaaaatagtgatggtggtcagaaaaataagcctcgtgaacatattatagactgtggagatatagtctggagtcttgcttttgggtcatcagttccagaaaaacagagtcactgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattggagggggcatcaga

SEQ ID NO: 42812 - DNA, 352 bp, Homo sapiens
gagaagcgagtatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 42813 - DNA, 375 bp, Homo sapiens
aaatcggggggtctcactgttgcccaggctggagtgcagtggtgcaattacagctcaccacagtctcaaactcctgggcccaggcaatccttctgccttagcctcctgagtggctgggactataagtgttagccaccacacctggactagtttccacaattttttgaacacaactcacagttagaaatacctttgatatcacaactcacacacacacacacacacacacttatacttgaaataaaagtttgacacagtatgtgtgcaatgcactctgatattttctattatgttcttgttcatggtttttcgttttttgagacaggctccagcctgggcaacaaagtgagactgtctcaaaaaaaatgtatatat

SEQ ID NO: 42814 - DNA, 424 bp, Homo sapiens
catgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtg

SEQ ID NO: 42815 - DNA, 419 bp, Homo sapiens
atttactgatttactaattactaaaatgatttctagaccaggtgcagtggttgacgcctgtaatcccagcactttgggaggctgaggcgagaggatcacttgagtctaggagttcgagattagcctgggcaacagggtgagaccctgtctctacaatgaatggaaaaattagctgggtatggtggtgcacggttgtggtctcagctactcagaaggctgaggtgggaggatcccttgagcccaagagtttgagggttgcgatgagctacgactgtgccactgcactccagcctgggtggcacagtgagaccctgtctcaaaaaaacaaataaaatgatttctaaattacgtactctaggaataaggaaattatttgtggaataaaggcctgagatacaaggactaatgagcaaaaatac

SEQ ID NO: 42816 - DNA, 253 bp, Homo sapiens
atattttaaatatcccagtactcactttttccaatgatcctagtaattgcctagaaatattctttctcttacctgttatttattcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 42817 - DNA, 175 bp, Homo sapiens
gattgtgtgtctatccaacagggagcccagtatttaaattgaccaacctaatgttacaactactttgaggtggccaaatgtaaactaagagccttaattaaagtggtgcaattttgtataacttagcatcagtagttcaataaatttggattgccatgcaagggcttgcattatg

SEQ ID NO: 42818 - DNA, 428 bp, Homo sapiens
attacaaatatgaaatataaatatttggtatatttgattagtcttcccttagtctgtaaactctgaaaggcaggatcaggtctcatttatcctggcatagccctcagtgcctggctcagataagaaatttagtacacatataatgaacaatcaaatggtgacaatgacctaggctttcatttgattcctagaaaacaacctctatgtagatgttgactaagtcctgtatgctctctgttatgaaaaatactctgtatactactaggcatgtgctatcatccagtccttatattacggcttttcatttagattgatttttatggagcacatgaacttggccctcaaggagcttactctgtaggagaatacaaagtatgaggtgtcatcaaaggtatttcacgttgagactgatgttgagatgtttctat

SEQ ID NO: 42819 - DNA, 346 bp, Homo sapiens
aattccttttttttaaaatttttttctgtcgttaagctagcattggctactaaatcaaaaaaagtgttgggttgggcatggtggctcatgcctataatcccaacactttgggaggccgagacaggagggtcatttgagaccagcttgggcaaacatagcaagacccttactttacaaaaataaaataaaataaaaaattagccaggtgaggtggtatgaacctatagtcccagctactgaggagtctgagatgggaggattgcctgagctcaggacttcaagcttgcagtgatctatgactgtactacactccagcctggtcaacaaagcaagaccatatctcttc

SEQ ID NO: 42820 - DNA, 140 bp, Homo sapiens
  misc_feature 138: n = A,T,C or G
gacttttgtcttgatattacttggcttgtatacctttgctctatttgcatgctggccttactctgccactgacaggctgtctgtatggtgtggaagaggacggctagcatccccatacctgcatccatacagtttgtnat

SEQ ID NO: 42821 - DNA, 302 bp, Homo sapiens
gaggaagggatctgcaatcttgccttatactctgttatttgttgagatgttcatgaaaggccttttttagaaatccgtatggatgccgattactctttatattgagttggcaagctgtgtgaaaggccagatagtaaatgttctgggtttggtgaaccatatggtttctattgtaactattcatctctgcccttggagcaccagagcagccgtaattaatatgtaaatgaataaacagagttgtgttccagtaaagcttcatttatggatactgaaattttaaagttcatataatttttttt

SEQ ID NO: 42822 - DNA, 399 bp, Homo sapiens
  misc_feature 4: n = A,T,C or G
gacnagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaagggattatttcctatttagaggatgggtgacattcttggaaagtacgtagactgaaataagtcactattgaaatggcatcaacatgatgctgcccattccactgaagttctgaaatct

SEQ ID NO: 42823 - DNA, 362 bp, Homo sapiens
  misc_feature 362: n = A,T,C or G
aggttagtttccctcagtacatgtgggcacagttttcttcgcttaagggaaatcttaggagagggacattgatacttttacttgcctttaatttgtttacattactgcccaagcagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaacccagcttctaagttcagttctgcaagcaagtatgctgctctctctgttgtgggtggaagatgaaaatgaggggaan

SEQ ID NO: 42824 - DNA, 388 bp, Homo sapiens
acctgatttatactcgttttctttttttgtagagacaggggtctcactatgttgcccaggttggtcttgaactcttgggctcaagtaatcctcccacctgggcctcccaaagtgctgagattacaggcgtaagccaccgtgtccagcctgatttataatttttaaaaatcactcggggctgggcatggtggctcacacctgtaatcccagcactttgggaggctgaggcgggtggatcacttgaggtcaagagttcgagaccagcctggccaatatggtgaaaaccccacctctattaaaaatacaaaaattagctgagcgtggtggcacatgcctgtagtcccagctactcatgaggctgaggcacaagaatcgcttgaaactggga

SEQ ID NO: 42825 - DNA, 326 bp, Homo sapiens
gctcaaagtggaatctgaccagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaact

SEQ ID NO: 42826 - DNA, 461 bp, Homo sapiens
gattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctct

SEQ ID NO: 42827 - DNA, 373 bp, Homo sapiens
atttaataaaaactaccaataaagtacaataagatacaccatttaattttttcaccttaaatttttttcttaaaaaaaataaaaacagtgaaatacatcttaaattacttcactgcctgttacactgagagtcccagtgatagatctgttttattactgtttgtttcaataaccatttcctgtctccctcttgcttccagcaacattctcaaaaccacgctcacaaacaatagatgctgggggcagtggcactgaagcatgacgtactcatcttcattctcctctgggcctggttaccaccaaagcacaaaagcccagctcccacaccctcaagagcaacatcctgaagggggattgaaggggggatgtattg

SEQ ID NO: 42828 - DNA, 470 bp, Homo sapiens
gacttgaaattatgtgtgaaggaacctggcccacggaagttgccctgtaaattcagattcactttcccttggacatatggatgacattagctcattacagttatgacctccctaaaactcccaaatattctttaagttcttctcttattttccctttagtttgtagtcatatttcttagttcttatatcagttgggattcccacatcttctagttggacaatattggagaagacaccacattttaactgagttccagtgatatgacaggctttcaattctctaatctcacagaagttagaaaaaaagtagataatcaaaatccacagaaaatatagaagattccattaactctgagaatgattctcaggtatccttaggacctcaagaaagctgttctctcctgggcctgtagagagttcaagtgccaggaatctaccacaaagtagccgggagggtgcagggcagcagg

SEQ ID NO: 42829 - DNA, 472 bp, Homo sapiens
aagatgtagctgtgtagtctccttcctagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctgcgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggca

SEQ ID NO: 42830 - DNA, 193 bp, Homo sapiens
gagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttc

SEQ ID NO: 42831 - DNA, 353 bp, Homo sapiens
agctcgaggcctgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctgggaagtgtcccacctgctgctcataataaatgcagatgtatagcga

SEQ ID NO: 42832 - DNA, 297 bp, Homo sapiens
acttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttcc

SEQ ID NO: 42833 - DNA, 292 bp, Homo sapiens
caccctgagtgtccaaagccgccagcgtcatcaaccggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccagcccacctgtgaataaatgtttttgcaggaaaaaaaaaatt

SEQ ID NO: 42834 - DNA, 359 bp, Homo sapiens
  misc_feature 131: n = A,T,C or G
gacatgccagagacagctggaaaggaaggaaacaaagtgtcggggggcaacatcatgtcaaggttttgcagctcttcagtgactgctctgggacaggtaggctgttagagggaggtctttgaggggcttanggagcaagtctctcctcttctggggttggaggccttattctgcagccctgaggtaccttggttctttgagtcaaatctgatgttgaactcgctccatgtggagaacccgtctgtagcaggcactgagcaaatgtctgttaattgaatccatgatttaaatgaaatctggagttggcttggattcatggactcatgcctgtaatcccaacactttggaaggttgaggtg

SEQ ID NO: 42835 - DNA, 347 bp, Homo sapiens
  misc_feature 109: n = A,T,C or G
agggtttggactaggtgttccctggtattctgtgatctgcctcttgctgccattctttctctcctctgcttctctgtatttttcttctgttatccctgggggtgctcangttcacttgattgtctgtatttccgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatg

SEQ ID NO: 42836 - DNA, 333 bp, Homo sapiens
  misc_feature 6, 261: n = A,T,C or G
cacagnaaggaggaatgactcaaatgcccaaaaccaagaacacattgcagaagtaagacaaacatgtatatttttaaatgttctaacataagacctgttctctctagccattgatttaccaggctttctgaaaggtctagtggttcacacagagagagagagagtactgaaaaagcaactcctcttcttagtcttaataatttactaaaatggccaacttttcattatctttattataataaacctgatgcttttttttanaactccttactctgatgtctgtatatgttgcactgaaaaggttaatatttaatgttttaatttattttgtgt

SEQ ID NO: 42837 - DNA, 201 bp, Homo sapiens
  misc_feature 5: n = A,T,C or G
actgnggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgttttt

SEQ ID NO: 42838 - DNA, 403 bp, Homo sapiens
gaaaaaaaggaactggagcataatgctgaagagacctatggtgaaaatgatgaaaatactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcggcacccaatttctagacaacgctcagccaacggattcttttcaagctgctcaaacataaatctgcctactgaactctaggatatttaattacaaaaattaagaacttagacttttttaaaacttttgtattagaaatgcgcatacatttatatgaatatattttgataacgtaggtctagagcttcttttatat

SEQ ID NO: 42839 - DNA, 391 bp, Homo sapiens
  misc_feature 6, 32, 57: n = A,T,C or G
gttggngaatatgtgcggcattatccacgagncaaacgggtcatcgagcagctcggngggaagcagctggtcatgaaccacatgcatcatgaagaccagcaggtccgctataatgctctgctggccgtgcagaagctcatggtgcacaactgggaataccttggcaagcagctccagtccgagcagccccagaccactgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtat

SEQ ID NO: 42840 - DNA, 389 bp, Homo sapiens
  misc_feature 18, 306, 348, 376, 380, 381: n = A,T,C or G
catggccagtttcagaancagggctgtgccttcatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccanaattgagggaaaataggcaggagggaacccacactgaatttnccagactctactgctgaaagacattgcntatnngcctattg

SEQ ID NO: 42841 - DNA, 369 bp, Homo sapiens
gtttctctactgcagtgtgacactgtactctctcaagattgctgactttaaatggcacctcagtgaggcttccctactacttaactcttagttgttgttggttttttctcagtgaagattcctatcttacgcccaccagggatggcattctatacatgtgaacactttcccattcacaatcaatccagcatctagcacaggaggtccctctccccagaatacaaggaatggtcttgatcctgttgttctgagatcaagaccatctcctccgtataaaagaggtaaaaagcttacttgaagacaattttatatatatggtagctggaagccattgcttcaaaattaaatagaatgctaaagtgaatcttg

SEQ ID NO: 42842 - DNA, 360 bp, Homo sapiens
catcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattggtatgtacacaaactaagtttctatatgtgaagttagtgagtctttttgtgttactccaaaataaaggcaatgatttat

SEQ ID NO: 42843 - DNA, 422 bp, Homo sapiens
  misc_feature 44, 69, 74, 421: n = A,T,C or G
tatggcacggggaaggaggtcctgggtgactttggaagtccgtngtgtctcattgcagataatttttancttanggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccana

SEQ ID NO: 42844 - DNA, 469 bp, Homo sapiens
  misc_feature 5, 11, 117: n = A,T,C or G
gtagnagcaanagggaagaaaagcagcatcttgcctggatgagaccaggggacacaaaaagagaagcccactatctcatttaatctttacaactctcttgcaaggttccctggttgngaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgat

SEQ ID NO: 42845 - DNA, 170 bp, Homo sapiens
agctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttc

SEQ ID NO: 42846 - DNA, 450 bp, Homo sapiens
  misc_feature 445: n = A,T,C or G
cagggcacagatttttaagaagaaaaacacttcttgtttcgttttatttcccaagggagatatctcacttaaccagatgccttgcgatttgtcacaatatagatcatttacacagaatttgtgtccagtcgtccatctatttgatttgcacaccatgaataaaataagcaaaatggataaagcttctaatactcccaattaaaaaattgctatctattttttcaccattaatatgctatcccaaatggcatttatcaccatactgtctcaccatatttattcgtatgctgttgttttctcaagatacgttcaattcagattatgtttgacttgcagccatatcaataatatgactaataataaacaacagtctaggatttccagtttttagaaaaacgataataaatttgaagtgaacctatattcagatttacattttacttantattg

SEQ ID NO: 42847 - DNA, 265 bp, Homo sapiens
  misc_feature 184, 209, 218: n = A,T,C or G
catcctagtgggaaatatttgacagcccaggcatctccttggagagaaaatgggtggagcagtggatggagagggatggagaagtataagaagcagacatttactgaagttgaaagtcacctccaccacacttttgctgaggactacagtcttgtcagtggttgcaaacttttttttttgaggnggaggttgcagtgagccgagatcgngccattgcnctccagcctgggcagcaagagtgaaactccatctcaaaaaaaaaaac

SEQ ID NO: 42848 - DNA, 207 bp, Homo sapiens
  misc_feature 10: n = A,T,C or G
gattcaaatntaaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattg

SEQ ID NO: 42849 - DNA, 435 bp, Homo sapiens
  misc_feature 9: n = A,T,C or G
atctgaaanagtcactttacagaaacagtgtgtaccattccgacgttacaatggtggggttggcaggtgtgcgcaggccaagcaatggggctggacacgaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatg

SEQ ID NO: 42850 - DNA, 402 bp, Homo sapiens
  misc_feature 4, 34, 60: n = A,T,C or G
gatnaccgtgctataatgtactgaaaccaccatnttacagaaatatttactacatatttncccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatat

SEQ ID NO: 42851 - DNA, 341 bp, Homo sapiens
caccacgcctggcccatgaaccaagtgtttttaaggaaacaaaactatttttttaatcctcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcatttctcctggttattggtttgtttgtcattaaagatatattttgaat

SEQ ID NO: 42852 - DNA, 469 bp, Homo sapiens
agagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaat

SEQ ID NO: 42853 - DNA, 160 bp, Homo sapiens
  misc_feature 159: n = A,T,C or G
agcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaagccnc

SEQ ID NO: 42854 - DNA, 310 bp, Homo sapiens
  misc_feature 270, 281, 295: n = A,T,C or G
gcagtggctcacacctgcagtcccagtactttggggggaaaaggtgggttgatcacctgaggtcgggagtttgagaccggcctgaccgacatggtgaagccctgtctctattaaagatacaaaaattagctgcaggtggtggtggatggccatagtcccagctactcgggaggctgatgcaggagagtcgcttgaacctgggaggcggaggttgcagtgagccgagattgtgccattgcgcttcagcctgggtgacagagtgagactcantctcaaaaatnttttttaataatantttttttaaaaaaag

SEQ ID NO: 42855 - DNA, 395 bp, Homo sapiens
cgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgaga

SEQ ID NO: 42856 - DNA, 347 bp, Homo sapiens
  misc_feature 34, 60: n = A,T,C or G
tgaacacagtatgtcgtgcaaactgtactgtgancaacagttggtttaaaatatgagggncaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttatcttattttatcttat

SEQ ID NO: 42857 - DNA, 438 bp, Homo sapiens
  misc_feature 7, 49: n = A,T,C or G
ctggtcnttcgtatttttggtggagatggggttttaccgtgttggccangatggtctcgatctcttgacctcgtgatccgcccgcctcagcctcccaaagctaattctgattctctttcttgctaaccctagcactataaacaagttacttggcctcatgttcttcatttataaaaggatgggcttggccaaggtagattgttggcttgcagatttagtgtgcagaagattcagtgtgttataaatgtgcattccctgagtctcatcccagagagattctgattcagcggggtctttaattgggcccaagaatcttcattgttaacaagaatttctaaatgaatctaatgcaggtggttctctcatcccacttcaagaaacttacttgaaatatctcctagtcaagaaaagagattggaagctggaatagatttgaga

SEQ ID NO: 42858 - DNA, 475 bp, Homo sapiens
  misc_feature 6, 474: n = A,T,C or G
catganagtacatattggagaaaaaagttgattaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtana

SEQ ID NO: 42859 - DNA, 231 bp, Homo sapiens
  misc_feature 55: n = A,T,C or G
attcttaaaatgattctattttaccaagtgacatttggatttactttggtaaccntagctttaggaaaagaagtggacactttggataattaagctaaaaataccctaaaagcattctgttcttagtaatacatcttttttacttataaaaaattaattgacagaaatggtaatcataagttcagtaattatattacagatgggtagttaataaaatattcgtagacatgc

SEQ ID NO: 42860 - DNA, 422 bp, Homo sapiens
gagataagatcaccccactctacttcagcctgagtaacagagcaataccctgtctctaaaaacatgaaatacagaagttcctggactgcagaggaatgttaatggcatgctgatcctacctgtgttccatgaacatgagcctctgtactagaaccaagaatgaagggaaagagcttactggccttgggtctcttgccttgcctcacatgttgtaggtctgccaggtcttcccatgagaataccctgcatgagcataaatgaaaaatggtaaagcaagattgccccagagctggcacagccagagtttcaaggcccagaacccagacattagactgagtggtgtggcttccttagaaacaaatttcatctaaaataagttacttctgggtgctaatatatctgaggtttttaaaaagggtgat

SEQ ID NO: 42861 - DNA, 327 bp, Homo sapiens
  misc_feature 9: n = A,T,C or G
tttatgatnagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcagtaagagttcaagtttcctaagctaaactatgaaatccaccagaaatatgtgcaaaattttgattactcagaaacttttttcctataattagaattgattctggcaaggggcaacatggcaaaaccctgcttctact

SEQ ID NO: 42862 - DNA, 490 bp, Homo sapiens
  misc_feature 213: n = A,T,C or G
actgccctaacaacaacaaactgactaagacttagatgaaattaagttagtagctttcctacatcctcattccagaatgcttcaatgaactgcagatcctttcggttacaagtaacagaatatcagactaagagtggtttaaacagatagtggtttgtttctctcacataagaaggaaaccagaggcagtcgctgacattgtttaagcagctngaatcacatgacctttcactgctatttttttataacctcagcattttttgtatgttttgtcaaagcccaatccctgaggcttatatattacctcaaaaatttgccacatttttctatttgtggatatttccctgtatcagtaagaaactaattaataattctaaattgtctccctaagggaggaacaaggtaaatagaaaggagaaacagagaaacagtggctaattgtgatgcataaactgaatgtggactgccttgcatagcagctgaactcctg

SEQ ID NO: 42863 - DNA, 425 bp, Homo sapiens
  misc_feature 6, 7: n = A,T,C or G
tattcnntgtaggatattccagtacttatatttacttattatgtatttatattatatactatttatatgtttgtatattagctatgttttcttacattttttatttactgaaagtgctgatatggaggggtagataagagatgattaaaaatggaaagtacattagaaatggtgaatgtgtatacaagatgaatcattcaacaatacaattataaagggtcaagtgcaaatcataaagtggattgagaagaagcaaaatgagtgagaatcactaccataagcctctcccttgttcttaagaaatgtcccctagctagacatgcacccatgggttacttggatttttttcaccttggaattttatgaacaaatggacttaggagcagcctttcattacagaacctaacttggtggtggatagagga

SEQ ID NO: 42864 - DNA, 372 bp, Homo sapiens
  misc_feature 209, 368: n = A,T,C or G
aggtagagctgtgtctagtatgcttcagaaacagactgctgttttctttattgacagttttccaggcaaggaaaaaaaaatctctttgcattctcctctcccattacctctctctgtatctctttgatagttttatttatttattttttattaaaaattttttttgggggggacagagtctcactctgttgctcaggctggggcgcagnggcacaatctcggctcactgcaacgtctccctcctgggttcaagcagttctcctttctcagcctcctgagtagctggaatgtaaggcgcgccccaccacgccccgctaatttttgtatttttatttatttattttttgaggtggagtcgtgcactttancctg

SEQ ID NO: 42865 - DNA, 131 bp, Homo sapiens
  misc_feature 7, 8, 48: n = A,T,C or G
gaccagnngcagggaggtgttctgattccttcataaatagggtaaccntataacatgcaagttggaacacttttgaaagcaaaagtgggcaacaaaaaactgaaaattattattaccagataaaggttttg

SEQ ID NO: 42866 - DNA, 371 bp, Homo sapiens
  misc_feature 209, 332: n = A,T,C or G
attcttcggcttcagtaaatctttttttcttccttcatatatatatacacaacacacacacacatatgtatatctatacacacatgtgtgttgtgtgtgttgtgtatatgcatgtgtgtgtgtgcgtgtgtgtatagttttagctccaagccaagcaagtttgtgtttggatagaggggatcttaactattaactacaagttgtatgtntggggtatcttgattttcccatttctaaagatgaatttcacaaagccataaagcgtgaaattagagctggacttaagactcattggccgaccatcctgtgtcctggcgtggccctgcagtaanaagcgtgtctgggtctggagaagggtgcttccgagagtg

SEQ ID NO: 42867 - DNA, 440 bp, Homo sapiens
  misc_feature 8, 33, 212: n = A,T,C or G
aagtgaancagattttagaaagtacttgtagtncatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgnctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcaga

SEQ ID NO: 42868 - DNA, 461 bp, Homo sapiens
  misc_feature 32, 450: n = A,T,C or G
aaggacccatcatcagggcatctatgtacttnttgacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctctagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacnccaagatgcag

SEQ ID NO: 42869 - DNA, 388 bp, Homo sapiens
cgcggggcccgaaacgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccgggggga

SEQ ID NO: 42870 - DNA, 490 bp, Homo sapiens
  misc_feature 16, 21: n = A,T,C or G
ataataccaaagattnaattnacttatactgctctcacttgctctctctctgtctctctctctcacacacacacacaattataagacctacaaggagaaatacagatatctatatagttagaaattttaaaacacctctcagtaattggtgcaatctagagacaaaataaataaggatatagaaaatttgaacaaagttaattaacaaacatcatctaattataaaacattgcactcaacaaatacagagtagatattcctttcaagtacacatagaatatttgccagtgttctctatttggtgagtcataaagcaactcttaacatattgatggaaatcatagagtataggatggaaatcatagagtatattttccaactacagtgacattaagctagaaatcaattacaaaaaatataaatgaaaaatccccatatgtttagaagttaagcaatcacaagtcaaagaataaatggcaatggaaagtag

SEQ ID NO: 42871 - DNA, 457 bp, Homo sapiens
  misc_feature 5, 58: n = A,T,C or G
aaatnggcattaaaacaatttgttaagagtagctttagaagcaccaatgaaggggaantatcctacatttactctggttgttaaaattttaaaaaggaatggggagagagagagaaagtgacaactctaggagaaaaccacaatcataagttttaattcagtaatttcaaaaatagccattggaaggtgtctattttcaattgagactactcccttaagggggtgttcagaagaatgtctgcaaaagagatctttttttaagttcagtcacttttaagggttagtccttgtcctccttgtcctggatttgctcagattctcgcgttcttttttctgtctctggaattccatagacagtaattaaggaactggaggccagcaggaggtcagggggccttcctcagtgaaaacagggattgttggccatgcacaacactcccttttttccttgtggtga

SEQ ID NO: 42872 - DNA, 223 bp, Homo sapiens
  misc_feature 165, 169, 182, 215: n = A,T,C or G
acccaggctgaagtgcaatggagtatcttggctcaacatatcactgtaggcttgacctttcagtctcaagcaatcttcccacctgagcctcccaagtagctgggactacaggcacataccgccatgcttggctaattttgtgtgtgtgtgtttgtgggggacaangctncttgttgcgggcncccaggctgggtctcaaactcctgggctcaacnaatacttc

SEQ ID NO: 42873 - DNA, 337 bp, Homo sapiens
  misc_feature 1, 7, 221, 322: n = A,T,C or G
nattgancaattgctttcacaaaagactgtatgttgtatttattgggatgtatatcaagctattgattgtattgcttgaatcatttgcactcttatcatgcttaatggaacagtttctgatggagatgtgttgaaaaaaaccactatgattgtgtatttgtcaatttgtactttacattctggtaatttttggcgtatgtatttcaagggtattttgttangtgaagcaaatttatgatttctacatcttattagttatgttttctttttattattagctccctttttatctttattagtattgttggccttaattctattngactaaattaatact

SEQ ID NO: 42874 - DNA, 151 bp, Homo sapiens
  misc_feature 32: n = A,T,C or G
gcaccagtatgattaccttcagcatgattacnatgtattaccttcagtatgattacagaagtcctacttgacaatcacatatagaagaacggtgctattcagtaagttctctttcctttcccttggagggaagacagcagagtcatcagtt

SEQ ID NO: 42875 - DNA, 465 bp, Homo sapiens
  misc_feature 30, 56, 209: n = A,T,C or G
aagaaatgcgtttagatcttggatgcaganctttcaaagggttaaatgtaaccctntggatcaaccacatgcacatccttactacagaatccgtcctttcatttcaacttatagcaagctatgatttttatatataaatattatataaataatgtataaaacattaaaagttaactatgtaagatattatttctgaaacaatttagctntatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgcaaggttccattttgtaaagagaataatattcaaagacttttgtagcatacaaagtgaaaacttgtatctg

SEQ ID NO: 42876 - DNA, 449 bp, Homo sapiens
cagtgaagaagataatggaaaagaaataccacaatgttggtcttagtaaatgtgaaataaaagtagccctgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggacatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgcca

SEQ ID NO: 42877 - DNA, 144 bp, Homo sapiens
aaggggctttctgtttagtttttttccaaccttgcctggggcgcctatgatggagaccctcagcccctagggactccatcttttgaccttgaagtctcgctcaaacattcccctaaaagaacgggggtgagggagaatggaagg

SEQ ID NO: 42878 - DNA, 346 bp, Homo sapiens
  misc_feature 31: n = A,T,C or G
aagtctcctttgcctgatgcacggcgggacnggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgta

SEQ ID NO: 42879 - DNA, 335 bp, Homo sapiens
  misc_feature 31, 58, 63, 210, 211: n = A,T,C or G
gctctcccggggacgttgtctgcaggcactnttaatggtccagcgtttgacataccgncgtangctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgnnagacctaaagttcttatgagattgtccaaaacaaagaaacatgtcagcagggcctatggtggttccatgtgtgctaaatgtgttcgtgacaggatcaagcgtgctttccttatcgaggagcaga

SEQ ID NO: 42880 - DNA, 111 bp, Homo sapiens
  misc_feature 7, 8, 19, 59: n = A,T,C or G
gaaagcnnctttgaacagnaaataaaatgaaaccgtaacttaatgaaatttgtggggtnccactagagttgttcttagaaggaaatatgtagttttaaatgtttatattag

SEQ ID NO: 42881 - DNA, 215 bp, Homo sapiens
  misc_feature 210: n = A,T,C or G
cacagatattttaaatgatagttttgaagttttgtcatagtatagaaaaatgattggcataaattatgagaaagccagggctcctctatctatactatgattgccaccatattacgataatgcatagaatgatttttctcccattcttttctgcttggaattttaattatgcttttaactcattggccttttttttaaaaaaaaaaacanttcct

SEQ ID NO: 42882 - DNA, 177 bp, Homo sapiens
aagctttttctttttgatttatgttttttatgtcttatttgagaaatccttctataccccaagatcatgaggatgtttcctgtgttctcttctgaaagctatatagtctttgtcatttaggtttatctttatacgtggtatgaagtgtaaagttctacttttaattttttgcatatt

SEQ ID NO: 42883 - DNA, 300 bp, Homo sapiens
  misc_feature 3, 9, 227, 292: n = A,T,C or G
aantcggtnttaggccgggtatgtgccagtccactttgagcttctgtggaggactctacctaaggtcagagcagcgagataccccacctccctcaacctcatcctctccacagctgcctcttccctcttccttccctgctgggaaagaagtaactacagttagggctcctattcaacacacacatgcttccctttcctgagtcccatccctgcgtgattttgggggngaagagtgggttgtgaggtgggccccatgttaacccctccactctttctttcaataaaacgcagntgcaaaca

SEQ ID NO: 42884 - DNA, 174 bp, Homo sapiens
  misc_feature 166: n = A,T,C or G
cattgtcatcccatccaagtagtgctttgcttctgtatcatattggtaagttgggagcaatacacttcattatgtttgaatgttatcttaaaaatggtggttcatgatccaggcgcagtggctccatgcctgtaatcccagcaccttgggaggccgaggcaggaanatcacttg

SEQ ID NO: 42885 - DNA, 430 bp, Homo sapiens
catgaactcgttctgcaggagaagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcac

SEQ ID NO: 42886 - DNA, 132 bp, Homo sapiens
caccccgggaaattcggccttatggccggcacagtgttgggagaagtcacaagttagttatagcaggcagtgaaagcagtttatgtttttccatgaacaaattggttccatgtcttgtatttaggcttcttg

SEQ ID NO: 42887 - DNA, 284 bp, Homo sapiens
caacctggccctgaaaaactacagtgtggtaagttcttagaaggaatgtaattgacatgtttgatcacagactgatgctcccagttgtgctagaggagaaccatgattctccaagctgattaggtattaatccatcctttagtattttccaaggtaaagctcaagatcttaaagttgggaagaattttgggtgtcagttagttcaactccaccagctgtaggactctcttctgcaacatcctctaccagtgtttgttcagtctgtggagagaaaagacctgagc

SEQ ID NO: 42888 - DNA, 325 bp, Homo sapiens
  misc_feature 1, 12, 299: n = A,T,C or G
naggacttctanagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcanagccacttgggtctcctgcatggaag

SEQ ID NO: 42889 - DNA, 334 bp, Homo sapiens
  misc_feature 333: n = A,T,C or G
caggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctcttggcgaatgctgcttgcgaatgtgtgcgacgccttccgtgtgatggaaacacactaccccgtcggacttcgaatttctacgtggatgtgcatgaagctnt

SEQ ID NO: 42890 - DNA, 214 bp, Homo sapiens
cagagcttgtgtttatgagctaccattttgctaagagctgtgagagaaataaaggtctggaaatatgcagttaaaacagggcctataaaattaaaaccaaattaaagtatagcagaggattactgcacagactgtactcgacaaaatatattttaagtgacgaggtgaaatctaaatcagttttgtttgaatttggttggtatttatgaaattc

SEQ ID NO: 42891 - DNA, 396 bp, Homo sapiens
attgtggtccttgtggcttctctctctagcagcacctcctgtcccttgaccttaactctgatggttcttcacctcctgccagcaaccccaaacccaagtgccttcagaggataaatatcaatggaacgcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattaga

SEQ ID NO: 42892 - DNA, 132 bp, Homo sapiens
gtaagaaggaagtgccatgtttcttagaagacttctggtgtttgtagatttgagaagggaggtgggagaggacttaggtgaatattaaaacaaacacataaaccaaatgaagacctctatctttccggcatc

SEQ ID NO: 42893 - DNA, 353 bp, Homo sapiens
  misc_feature 181, 216, 217, 223, 249, 301: n = A,T,C or G
caataagctgggtgtctaaaaggacagcttctcttccctcaatattgccatttttccaaagaaacatgttaaaaaaaaaaattataagacatggactagtcctcattagcatgtttgcatagcaaccagtcaagagcatttacactatttctgctgatatactcaccttaaaactgctcanaaccctggggctttatttttgttttaatcttttgnngccagngatgattttcctattctgcaaatagngtatttcctggattacacatagtatggtttcctgaagtattctgataaatgngttttttaaaacctcaatatactttttagaaaaggagcatctggttatgcat

SEQ ID NO: 42894 - DNA, 326 bp, Homo sapiens
gatccaggatccagatttatctgattccaagcaccttgtctttccccaacatctctggctccttttctgattcctaaaaagcccaaattcaggctggtgaacttgattgaaaagttgctatggaatcgtggggttttcatggagaaataaaaatgttcttcttatcctctcatcttatgaaccctcagtgtggcaggtgctattgagcaccaaggtgtctgaatagttgtgcaccttggccacttattctctgcacccccattttttcctgtaagcatgaggatcagcatctacctctaaggataatgtaaagataaataacacac

SEQ ID NO: 42895 - DNA, 291 bp, Homo sapiens
gcattccagattctggaagacttggaagacagcaggtggtccatacacatttgttgaatgtgagtagtcacagtaccaacctcgctgtgttgttatgcaggtgagatgacttaatactgtcatatacgcagggcagtcccagccctgagcagtgtgccctgaactatatttcaacacacagcgagagctggatctctcgagcaatcccacgtcccgtgtctcggcaggcccaggacagttctgcttttaacctgtttcctggagtaattgctaacagtgcttcctttcaga

SEQ ID NO: 42896 - DNA, 353 bp, Homo sapiens
gttacaaaaaaaagagactgggggagaacctggagatgggtgcaattttaaagatgggggttggggtaggcttcatttatatctgaaatctggccaaaatcttgagatagaagagggagttagctaagcagttatttgcagggaaaacattcaaggccgagtgaagagccaatgtaggggtgctgtaaggagcgggcatgctttgtttaaggaactagtgactactgtgtatacagccaagagattcagggagacaaaagtgcaagaaccacttagagaagtagcagaagggtaagggttggagaaaaacatatgcatacccttgcagatattgaaagggttttcttttttat

SEQ ID NO: 42897 - DNA, 473 bp, Homo sapiens
atagcagctcctccaatgaggaatgctgtaagtaagactcatcaaacagattttaacccttttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgact

SEQ ID NO: 42898 - DNA, 342 bp, Homo sapiens
agactgaggcacgtggatcatttgaggtcaggaattcaagaccagcttggccaacatggtgagaccccgtctctactaaaagtacaaaaattagctgggtgtgatggcatgtgcctgtaatcccagctacttgggaggctgaggcaggagaatctgaacctgggaggtggaggttgcagtgagccgagattgtgccactgcgctccagcctgggcaacagagtgaaactctgtttcgaaagaaagaaaagaaatgactaggacagcaggagtaaaaccccaaggcattaggtctccgtagctaaggtggatcccactcatgcaattcatcaacctttgtctg

SEQ ID NO: 42899 - DNA, 140 bp, Homo sapiens
gagagttaggtatcatggtcatcttttaaaatgccctcctcaccccacaaggggtgggaggtagtgagaaagacggccaggtgcaaggcagtgggacccaggtgtgttcaaggaagggtttgcttggtggactggtgatg

SEQ ID NO: 42900 - DNA, 476 bp, Homo sapiens
  misc_feature 475: n = A,T,C or G
atcatagacctgcaagcaaaccccctcaaagtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctana

SEQ ID NO: 42901 - DNA, 372 bp, Homo sapiens
  misc_feature 18, 209: n = A,T,C or G
gtcttgtgattgaaaatntgagcgaagtgaaattgccttgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatattnggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattg

SEQ ID NO: 42902 - DNA, 466 bp, Homo sapiens
  misc_feature 26: n = A,T,C or G
gaaccaagtactgtgaatccccaagnccaaggtagctgagaacagagaaagtcaatgactcctgtagaagcattctcttcatctctttggaagccttggcaagggtactgtggctattgaagaaaggtttgctttttggcaacactgaaacagatttaaattcatattgaaacaaatgacgcaagcgtctctagttaaaatagctttgttgggagaactggctagccatatgcagaaaattcaaactgaaccccttccttataccttatgcaaaaattaactcaagatagattaaagacttaaatgtaaaactgaaaatgataaaaaccctagaagaaagtctaggcaataccattcaggacataggcacgggcaaagatttcatgatgaaaatgtcaaaagcaattgcaacagaagcaaaaattgaccaatgggacctaattaaatgaaagagcttctccacagc

SEQ ID NO: 42903 - DNA, 470 bp, Homo sapiens
  misc_feature 198, 244, 261, 263, 279, 304, 310, 335, 347: n = A,T,C or G
gtgtaggagaaatacttttccttgtttgactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttttttttctatanacttttttcagataacatcttctgagtcataaccagcctggcagtntgatggcctaaatgcananaaaacagctccttggngaattgataagtaaaggcagaaaanattatntgtcatacctccattggggaataancataaccctganattcttactactgatgaaaacattatctgcatatgccaaaaaattttaagcaaatgaaagctaccaatttaaagttacggaatctaccattttaaagttaattgcttgtcaagctataaccac

SEQ ID NO: 42904 - DNA, 468 bp, Homo sapiens
  misc_feature 1, 8, 9, 50, 68, 206, 325, 326, 426: n = A,T,C or G
nagctgtnnatactccttcctagctgctctaagggggctggcaacatggntcagcaggcttgccccanagccatggcaaagaatggacttgtaatttgcatcctggtgatcaccttactcctggaccagaccaccagccacacatccagattaaaagccaggaagcacagcaaacgtcgagtgagagacaaggatggagatctgangactcaaattgaaaagctctggacagaagtcaatgccttgaaggaaattcaagccctgcagacagtctgtctccgaggcactaaagttcacaagaaatgctaccttgcttcagaaggtnngaagcatttccatgaggccaatgaagactgcatttccaaaggaggaatcctggttatccccaggaactccgacgaaatcaacgccctccaagactatggnaaaaggagcctgccaggtgtcaatgacttttggctgggcatc

SEQ ID NO: 42905 - DNA, 489 bp, Homo sapiens
  misc_feature 1: n = A,T,C or G
naattaaaatgctactactcgaacatttatatttttatattaaacttttgtaagtataacctgcttggtttcaaatatttcacatgcaacatgacattggttggaataatgttatgttgtatgtaaaagtgtaagttgtatgtaaaagattaatatcacaatcctttgaaatactttgcaccttgctattgaataaagttgatgacttttaattctgttgacataatctagaacccatagggaaactctatgataatgttttacttctagaaagtcagtcaataagtaaaaacaaaacagaaaaaacataaaaaacttttattatccatgcttatgaaatgagatttcaaatggagtcactttgatgcatcatacaaatgtatcaaattattgaaattttgcatcagcaggcacctcagagattaaatatatccttcaggaaatctagccttataacagtatcactagccttataataatcaggtagtt

SEQ ID NO: 42906 - DNA, 115 bp, Homo sapiens
aacataataaccgccacagcacaatgacaagatcaaatctacacaaatcgatactagccttgaatgtaaatgggcaaatgccccacttaaaaggcacagagtggcaagctagatt

SEQ ID NO: 42907 - DNA, 155 bp, Homo sapiens
  misc_feature 114: n = A,T,C or G
gattcagcagctcacagccctgggggcagctcaggctactgctaaggcctgagagtttttgcagaaatggggcagagggacaccctttgggcgtggcttcctggtgatgggaanggtcttgtgttttaatgccaataaatgtgccagctgggcag

SEQ ID NO: 42908 - DNA, 268 bp, Homo sapiens
gaattttttgtggggagggcttcattatgttgtatataaaatgtgaatgtggtaaatgtctaaaatgtgaattgtgggtgaatatgtcactgggcaaattgattattaggtgaattggttttaggcaaatttgatgttatcttgaatttgttaatgttgattttttctaattatagtcataattcatattcattgtagtcaaaattcatattcattgtaatacttaaaaaatacagagaagcataaagaagaaacttcacccataatc

SEQ ID NO: 42909 - DNA, 160 bp, Homo sapiens
tattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtgattaaaga

SEQ ID NO: 42910 - DNA, 175 bp, Homo sapiens
  misc_feature 2: n = A,T,C or G
cngggaattcggccttatggccggaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcaga

SEQ ID NO: 42911 - DNA, 352 bp, Homo sapiens
ctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgagga

SEQ ID NO: 42912 - DNA, 439 bp, Homo sapiens
caggtgtccatctcctatctttttgttccatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttat

SEQ ID NO: 42913 - DNA, 204 bp, Homo sapiens
  misc_feature 3: n = A,T,C or G
atnaagattttattgaactcttaactgacaagggaagcaatacgataataaagttgattcaaagagcatttgaggaactgggatttaaaaggcacgccaaaataattttttaaaaaatacaaatctagttaatgtcctacagaaaaataaaactggggttatttttcctactggatacaaatcacttgaatctctaacaggcca

SEQ ID NO: 42914 - DNA, 472 bp, Homo sapiens
atttctggatgctaagtccttcgtccccatctccgctcgcagaattactgaagtttggggtattccttcccccattgatactgtttttactaggtgcatgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatca

SEQ ID NO: 42915 - DNA, 377 bp, Homo sapiens
gagagtttgtacggagagagtttagggaactgctgcacagatttcctgcagaatgatggggcagctcatgaaaaatgatcaagattggaacgcaaagctggtgggactgatgtgctgtatggatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagatacctcgcccagagaaaaaggtcggatgcgttttcacagactacagaatgtacaaattgcacttgactatttgaaaagacgccaggtgaaattagtgaatattagaaatg

SEQ ID NO: 42916 - DNA, 313 bp, Homo sapiens
ctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggaccga

SEQ ID NO: 42917 - DNA, 374 bp, Homo sapiens
attgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgaccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacgga

SEQ ID NO: 42918 - DNA, 160 bp, Homo sapiens
  misc_feature 159: n = A,T,C or G
attcctaaaactttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggng

SEQ ID NO: 42919 - DNA, 285 bp, Homo sapiens
cacttaaagcgcttaatgtcttttattgctgtgacaattaggtccaaattattttaagtgatttgcaaggttcttagtgacctggcttgagctcttagctggaaagcagcctcatctaaacttacccaatacagtatgttcactctctgggtgatgggatcaatagaagcccaaacctcagcatcatgcagcataccttgcaacaaaccagcgcatgcactccctgaatctaaaataaaaatggaaattttgtaaaataaataaattaattaaataaaattacct

SEQ ID NO: 42920 - DNA, 471 bp, Homo sapiens
agcaaaggacaatatcaagaaagtgaaaagggctatgcattagtccattctcgcattgctataaagaactacctgagactgggtaattcataaagaaaataggcttaattggctgatggatcttcaggtcatataggaagcatggttgcagaggcctcaggaaacttacaatcatggcagaaggtgaatgggaagcagacacagcctgcatggctgaagcaggaggaagagagagaagggggaggtgctacacacttttaaacaaccagatctcatgagaactcaccatcacaagaacagcaagggggaagtttgcccccacgatccaatcacttcccaccaggcctgtcctccaacattgggggttataattcaacatgagattggggcaagaacacaaatccaaaccatatcaggctgggcacagggactcatgcctgtaatcctggcactttgggaggccaaagcaga

SEQ ID NO: 42921 - DNA, 338 bp, Homo sapiens
atcgctcgaggagaattctgcctaagccactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagga

SEQ ID NO: 42922 - DNA, 103 bp, Homo sapiens
aaacaggccgagtaagaacgtggagaagaaaattgacaaatacacagaggtcctcaagacccacggactcctggtctgagcccaataaagactgttaattcct

SEQ ID NO: 42923 - DNA, 329 bp, Homo sapiens
cagttaggacttgtgtagtttgaaagaaaaatctcacccagcataaaaagagaaaagggggaattgtaacaaatgttaatcataagcactgtttcaacccggaaaaatgtttgctgccaggctgtgggcaaagaggtggcctcggcggctggcagctcagtgggccttccaagtttactaagcagggtcttgtatttttaaataaaatagagcatcagacacgctcacttaaatataaaaaataataaaaacaagttttgaattaagtttaagacacattaagaataaaacaaatctaagaataaagggaatcagtgatttccaagccg

SEQ ID NO: 42924 - DNA, 462 bp, Homo sapiens
  misc_feature 129, 210: n = A,T,C or G
gattcacaaaatatttatgatgtatttactctgcaccaggtcccatgccaagcactggggacacagttatggcaaagtagacaaagcatttgttcatttggagcttagagtccaggaggaatacattangataatgacacaatcaaatataaattgcaagatgtcacaggtgtgatgaagggagagtaggagagaccatgagtatgtgtnacaggaggacacagcattattctagtgctgtactgttccgtacggcagccactacccacatgtaactttttaaggtttaaatttaaattagttaacattcaaaacgcagctccccaatcacactagcaacatttcaagtgcttgagagccatgcatgattagtggttaccctattgaataggttaagaagtagaatcttttcatcatcacagaaagttctattggacagtgctcttctagatcatcataaga

SEQ ID NO: 42925 - DNA, 308 bp, Homo sapiens
  misc_feature 98, 136, 211, 213, 261: n = A,T,C or G
caattctaagcagaaaaagaaaaaaaaacacaaaaaataaaaaacccctacaaaaaaactttaaaaaaaatggcagcaaagggtagttttcatctggngtcttttatttaagttttttaagttaagaaaagctggngacatatttatacgtttttgtgcaaaaataaatgaatggcaatagattttaaaaaatcttattatgtacttctgngngaaaaagtctgtataatatttcccttaaatatgcattattttacttgngagttttttactgaattaatctgaaatgtacaagccctggatttgct

SEQ ID NO: 42926 - DNA, 411 bp, Homo sapiens
cacaacagtttagagcatcttcaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaagcagcttcctagtttgtaaatagacttacttggtatattttta

SEQ ID NO: 42927 - DNA, 238 bp, Homo sapiens
  misc_feature 7, 211: n = A,T,C or G
gaaatcnttgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatntaaaataaagcttatatttcaaatgtc

SEQ ID NO: 42928 - DNA, 126 bp, Homo sapiens
agggcttgatttaccaggtacaggtggggatcagaaatctactcgggtctctgatgtgtttctaccttccgaagggttcaacttcaagccacacaaacatcctgaactgccaactaaggggaagga

SEQ ID NO: 42929 - DNA, 329 bp, Homo sapiens
aaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacatttta

SEQ ID NO: 42930 - DNA, 412 bp, Homo sapiens
atcccaagtcttttgagtttctgtgatgaaatccagtcatttagtttggaaataagctgtgatttggtctcatgtgccgattaaggaagggtggtgcacaataacttgagcagcttagctcattagcattggccagagaggcggcgatgcatcggaggcaagagtagggcccacaaggtgcccgtgcctggcaccccttacaggtgtgagccaccgtgcctggccaacagtaaatctttatagatacctcattggttacatctgtgcaattaagttcctgggcacagaattgctgggccaaagagatatggacttttagaattttttgaatgccattgcctttcgtagaagagtgtaataatttattcacccccttgtccagcagtgtgcgagagtgctcattcgtgcctat

SEQ ID NO: 42931 - DNA, 290 bp, Homo sapiens
agaataaatttatttatctatgccaacggagaaaatcgtcagtgttcttagaaatagcttattaaattattgtgttatttttcatgggctttgttactgagttaacaaaaaggagtagggcatttaaattttgggatagttgctttagattgcatgtgtaaattaatatcttaagtattttttggtaaagagttaagcaaagattgaattatttttagatatttttaaaattacagaaacactacatttaagttagaaaattaggaaaacagtcatcatatggagagaac

SEQ ID NO: 42932 - DNA, 387 bp, Homo sapiens
atggtcacattggagacaaaagtgtatccaagaaaatgtagtgtgcgttatagagaaattccaactggtcacactcaccattatggtttttcatgctttagagaaaatgctagatttatactgtcttttgttccatccttcagcttcccatgcattataaaggtggcacttaagtttttatctttgaaaagtgggccccaaagttttttggggtacaaaaagacatgtatgagaaccatattttctgtttctctttttcactctctaaactctttttgtataaataaggattatcctgggcataattcatttgaatatgaaaccaacatactttctttcatttttgtgaaaaaataaccaaaaacatgtattaatgtgatacaaaga

SEQ ID NO: 42933 - DNA, 289 bp, Homo sapiens
cttttgcggcctcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtg

SEQ ID NO: 42934 - DNA, 136 bp, Homo sapiens
attgtccatgactacaaggatatttttaaacaagctactgaagatagattaacaagtgcaaaggaattgccttatttcgagggtgatttctggcccaatgttctggaagaaagcattaaggaactggaacaggagg

SEQ ID NO: 42935 - DNA, 415 bp, Homo sapiens
aagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaataattctactcagtcagtacttaaaagcttgacatgtttgtgtggagacctgtgtgtgactgagttcagatcactctaatttcctgggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtg

SEQ ID NO: 42936 - DNA, 356 bp, Homo sapiens
agttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgc

SEQ ID NO: 42937 - DNA, 338 bp, Homo sapiens
  misc_feature 7: n = A,T,C or G
catgatnagaaaagagcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtg

SEQ ID NO: 42938 - DNA, 180 bp, Homo sapiens
  misc_feature 5: n = A,T,C or G
tgagnacgatgtggggtttccactgtgtgtctgtcatcacctcttcgtctttttttcctaaccctgatctcatacttgtatagagtaataacaacagttgtacttccaccaaaggcatgtggcatatttaccaatgtcatgtattctgaacaaaggcaaaaaatacaaattcctaccatt

SEQ ID NO: 42939 - DNA, 464 bp, Homo sapiens
gtgaagtcaatacctataattacgaagctgctttgggtctaaaagaggagctcgcttataatttgtttccattaacagcaataagcatttttttttgcaaaagccgaaagatctcatgtggctttggtagacactttgaagaccccgtgtaaatgaatatgtcattcgcaaacatattgaggtattaatacaaaaaagttaatgtctatcaaaagaaaagtataaaattcaatttaaatgctttctcaagcattattcttttctaaagtaaacactcgctcatgcattccaaagcaatggtccagcccctaatctttaattcagttccaggttgcacagccatcacaaagcgcctactaagcaccagacctttgaaagcatcccctgctttcaagcagcgacactcttttcagctgcagttcttaacagccaaaacataaaagcccagtaaaactttaattagt

SEQ ID NO: 42940 - DNA, 233 bp, Homo sapiens
  misc_feature 16: n = A,T,C or G
aagacacaatatattnaatatctttaagggtagggcctgtgaacctgtattttttgaagttttatgtgttatcctgatctaggattgagaactacttgtacaaggtattctattcttttgtgtatgtgtgtgtgtgtgttctagttagggagatgtcatataggtcagattaaaatgtgaggcagtgtgtggttaaacttgaaaatgaatgagaaagaggataaacactttag

SEQ ID NO: 42941 - DNA, 469 bp, Homo sapiens
  misc_feature 2: n = A,T,C or G
tncagtaatttttagccaatatggcatttgtaaatttaaactttctctcatggaaagggggctggtacctgtcaaagtgttattttatgcaacaatatagtcactttttattttggcaattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcataggatgcattaagaaatatcaacggataactgacatcgttttgttaagaagttaactgtatcatagctcactactgccagagcggcaatggatgtacaacgaaagagatgaaaaatacaaaagttattaagccacctgattaaaagaaaaccaatatttaaaggcatttaatagatatcaagtataactttgagga

SEQ ID NO: 42942 - DNA, 470 bp, Homo sapiens
  misc_feature 21: n = A,T,C or G
gagtgtgtgaaatcttcgagnaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttgga

SEQ ID NO: 42943 - DNA, 205 bp, Homo sapiens
atataaacttggacaaagaaacaaaaaccggcacatgcggttactgtgggctccagttcaggcagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaagg

SEQ ID NO: 42944 - DNA, 165 bp, Homo sapiens
acaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattca

SEQ ID NO: 42945 - DNA, 434 bp, Homo sapiens
atgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaatta

SEQ ID NO: 42946 - DNA, 174 bp, Homo sapiens
  misc_feature 138: n = A,T,C or G
atttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacactcttatgataac

SEQ ID NO: 42947 - DNA, 465 bp, Homo sapiens
cgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataatttaagctgtatatggtcttcattgaaaaaagatagatattgttacaggaagcttgttacattatattcttgaccttttggttgataatcttaaatcttaatgtaatttcaaactggcagaaatgttgccagcataatacatggatgtctcatataccctgcatccagatttaccagttgttatcattctgcccgttttttattgccccaaacctgttctgtctccctctctgtatgtacatacatacacgtat

SEQ ID NO: 42948 - DNA, 466 bp, Homo sapiens
tggctggagcttcttggggcagaggctgggcacgtggtgcattgcaaagtctggagggcaagtgccatggctgagatggtcaccagcgtcctgtggagggtagatctagtttctaaagggttggagagacccttcaaatgggaatcactggccttagaaatgggtagacagaatccttagccactggactggaaattacaggctcaatttattttacacagcaagctcaagggcacgaagaatcagtttataatgatctctgtggtatttgcaatatccctaaaaggtaacaaagcagcttcatctcatatttatatctacacggagttaagtagctgggacaaggccttcccgcttatgatcgagagagatgctgttcaactccaaatccctgcgctggctctgacacaggctgcaaataaggcagcttctcattgtctttccatttcttattttacctcatttg

SEQ ID NO: 42949 - DNA, 338 bp, Homo sapiens
  misc_feature 46, 327, 330, 334: n = A,T,C or G
gctttgttggttgctttgagttgtacaaagcaggacgaccaccagnaggctttctaagaaaaagaatcatagagactttgataaaattggaactcctaaagcagctaaggctttgcttctatttttgatcatttttaaaaagttagttcttctggtgtttggtagttccatagtagttagaaagcactgccacatgaaatctgctattggtagaaaaagaaaatgttacagccaactctgatacaacatgagagaaagacagagagagagagagaagggagagaagagacatgttcttctttgaccagcaggaaaaaaaaaaaagcngcncaancctt

SEQ ID NO: 42950 - DNA, 150 bp, Homo sapiens
ctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttt

SEQ ID NO: 42951 - DNA, 469 bp, Homo sapiens
  misc_feature 34: n = A,T,C or G
ctccagttcccaccacagtctcccttgcgccagnagcacgagagaaaggcaagcaggtaagaaacaaccagctacaattttagggctagtgtgacagtataaacctcttgggagacccaggcatacggggagttcacactcaattcacaggccattttccacatacctcccaccaggtgctcccaggaaagactggagcaaagcagaagattagaagcgcgccgtccccccaccccccagccagttgcaggcacacaggaaaaggcacaggtaaacacgcactgtgtctaacgatggaagggagaaagaagataaaaacctacaacacttctacccactgagagcagggcaggaaatagtccagagcccagtatcctgtaccaatccagctagggaagggctaggaaacttccccataagacatgcaacagataagtggtgccatgaagagaaggaacagaaatgctga

SEQ ID NO: 42952 - DNA, 369 bp, Homo sapiens
  misc_feature 356: n = A,T,C or G
cacactgttgaaggatcttaattctatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgtntgaagttgataga

SEQ ID NO: 42953 - DNA, 391 bp, Homo sapiens
tggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatga

SEQ ID NO: 42954 - DNA, 252 bp, Homo sapiens
ataacaaaaacagtcttaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggtatagtaacattattttaaaaaattacaaaatggtagttaaaatttagtttaaagtt

SEQ ID NO: 42955 - DNA, 371 bp, Homo sapiens
gacactagaaggaagtcgtgctacccccgcggtgttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctggagatcgtgttggaagttgttaatatctgctacttggaacatacgattgcctttcagaataaatattg

SEQ ID NO: 42956 - DNA, 286 bp, Homo sapiens
  misc_feature 3: n = A,T,C or G
atnataaattaaatgagaatttctgcttatcagtattttatataagcactgtctggaaattctacttaggacaatatttaagtagatatgaggcttaccttctggaaaagagattacaaaattatccttgttaattaattaactaattaagtccccaaaatgagaagagattcaattactatcaataatttgtagtaaagtgactgaaaaggaaatatataagctaatagattgattgccgtcctcaacaagttagcacatacttttatttttaaaaagtcttcac

SEQ ID NO: 42957 - DNA, 316 bp, Homo sapiens
gcaggctgctctcgaacacctgagctgaagcttcccaaggtgtagggattgcaagcgtgagccaccgtgcccagcctctacccaactcttttaggacacattcccaggagcctagctacgtggagaatagctaaagccccagccttcaacccttgcttaactcatagaggactgccatgtgagtgagccaactcagaggcaaattctcagttagctgatttgccccagctgatggtgcatggagcaaaatgagccttccccatgaagccctacccaaaatacagatatatgagcaaaataaatgattgttgttttg

SEQ ID NO: 42958 - DNA, 276 bp, Homo sapiens
  misc_feature 12: n = A,T,C or G
cagcaccccagnaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttc

SEQ ID NO: 42959 - DNA, 146 bp, Homo sapiens
agtaggtatggtggcacacgcctgtaatcccagctactcgggaggctgagacgggaggatcactcgaatccaggagtttgaggttagcctggacaacatggtgggaccctgtgtcttaaaaacaccaacaaaaattaagatcccct

SEQ ID NO: 42960 - DNA, 394 bp, Homo sapiens
  misc_feature 56: n = A,T,C or G
cggaccggagtaccttgcgtgcagttatgtcggcgtcggtagtgtctgtcatttcncggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgagga

SEQ ID NO: 42961 - DNA, 334 bp, Homo sapiens
gtctccgtgtcacattttggtaattctcttaatattcaaaaatattctcttggtcagttgcagtggctcacacctataatcccagcattttgggaggctgaggcgggtggatcacttgaggccaggagtttgcaaccagcctggccaacatagcaaaaccctgtttctactaaaaaatacagaaattagcagggcatggtgatgcacgcctgtaatcctagcaatttgggaggctgaggcatgtgaatcgcttgaacccaggaggcggaggttgtagtgagccgagattgggccactgcactcctgcctgggcgacagagtgagactgcatctc

SEQ ID NO: 42962 - DNA, 453 bp, Homo sapiens
taggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcat

SEQ ID NO: 42963 - DNA, 314 bp, Homo sapiens
cttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtatt

SEQ ID NO: 42964 - DNA, 360 bp, Homo sapiens
gagagatttatgggttgtggtactatgagagggaacctaggtagagtccagggaacttcctcagttgaagagatgaagctaagggtcaggggagaccaaagtggctggagttcacagacagaatatcagggtgaagagagagctgcacagaggatccctgagatctgcagaggcttccactgtagtgttcagcagagctctaatcagcccatatgtggaaactacctgaggctaaagaatcatcccaaaagattagattgaacggtacctggtgctcagatagggctataagtagtgccttttcttaccaggtagactggaaaaactcagttcatggagcattgggtagactactgagat

SEQ ID NO: 42965 - DNA, 355 bp, Homo sapiens
  misc_feature 4, 351: n = A,T,C or G
atgnctacgtgttatgatgccctttatgaaaaatacaagaacaggcaaaactaaggtatggtgatagaaatcaggacagtggttgcctctgggtaggggttgtggttgactggaaaggagcacaaggaaactttctggcatgatggaaatattctgtagcttgacttgggtgatggtaattcagttatatactttttgggtaacttcgttttcatgtaatttttaacttacagaaaagttgcaagactagtacaaagagcttccgtatacctttatccagttttgccaattgttatatacatttactcaaacatattgattgaaacttaagattttatagtatgtaaatcngcac

SEQ ID NO: 42966 - DNA, 119 bp, Homo sapiens
gatatttgggtaggttaagctgccatacgtgttcagtgtgaatagtgtttaagttgaaaatattgtaaaaaaattatattttttcaaaaatatttaaaaaaataaataatagtagaact

SEQ ID NO: 42967 - DNA, 387 bp, Homo sapiens
gagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatgg

SEQ ID NO: 42968 - DNA, 366 bp, Homo sapiens
  misc_feature 7, 8: n = A,T,C or G
ggatccnncgcccaggccggagtgcagtggtgaaatcatagcttgctgcagcctctattgcccgggccaaagcaatcttcccacctcagcctcctctagctgggacaacaggcgttcacccttcctggctaagttttttgatttttagtagagatggagaatttcccaggatggtctcaaacttctgggcttaagcaatcctcctgcctcagcctcccaaggtgctgggattacaggcatgagccactatgcccggccactgtataactttgattctccaaaaatttaactactaatagtctactgttgaccagaagccttaccaataaaataagttgattaacacatttttaaaatatgtattat

SEQ ID NO: 42969 - DNA, 388 bp, Homo sapiens
  misc_feature 6: n = A,T,C or G
tgaganagagaaagataaaatttaacttaggactttgataatttaagtatttacattaatttttctagggtaatataataaaataataatataaatagagcataaataatataaatagagcatcaacatttaaaaccagcagaggaaaaaaaagaagaaattaaagaaagtgaaaccaggaaaaatacaacaaaataaggtaaaaatacaaacatatcaataatttcagtaaacacctaaactaagtcctgaaagttatacgtcaaaatggtcagactggcttagaaaaagaaatacagctatgtgctatttgaaagagacatctaaaacatgaggacacggaaaagttgagaggaaagggatagaaaaagataaatacagtgtacca

SEQ ID NO: 42970 - DNA, 372 bp, Homo sapiens
  misc_feature 353: n = A,T,C or G
tgcagggcatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcactattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttanaagaagagatgctgtcttg

SEQ ID NO: 42971 - DNA, 357 bp, Homo sapiens
  misc_feature 7, 11: n = A,T,C or G
caatcancagnacaacatatagacacacatataaactggcaaagccagacaaagataaatatgagggagtccatgaaagcggggagagttaaagtctcggaaatgccctggaccctgtttggctctggagcctgggagtgaggctcagagctgacactcctaatggccttttctcacctctgctcctcagggctggttccatttaaatgaaggatgcagtcctttttgtttttgtttgattatggaacagagaaaaaaactattaaaaaaaaactcttaccttttactacttccgtaactataaatagcagtcatgatttataggaagtgaaaaatatatattttttaaatttagac

SEQ ID NO: 42972 - DNA, 170 bp, Homo sapiens
gctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacag

SEQ ID NO: 42973 - DNA, 296 bp, Homo sapiens
aggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagt

SEQ ID NO: 42974 - DNA, 131 bp, Homo sapiens
acctggtgtgcttatcttctttgttgctgatttgagagctgagctatgtactatatctggaatgcacacagcaggcatcctgctgtgcagttctgtgtctagttaatagtatggaagttcaggacatacct

SEQ ID NO: 42975 - DNA, 239 bp, Homo sapiens
  misc_feature 237: n = A,T,C or G
cttgttcacatgctattatgacttataaagtcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgcctntt

SEQ ID NO: 42976 - DNA, 302 bp, Homo sapiens
aggttggcggcgcggggctgaaggctagcaaaccgagcgatcatgtcgcacaaacaaatttactattcggacaaatacgacgacgaggagtttgggtatcgacatgtcatgctgcccaaggacatagccaagctggtccctaaaacccatctgatgtctgaatctgaatggaggaatcttggcgttcagctgagtcagggatgggtccattatatgatccatgaaccagaacctcacatcttgctgttccggcgcccactacccaagaaaccaaagaaatgaagctggcaagctacttttca

SEQ ID NO: 42977 - DNA, 372 bp, Homo sapiens
gttctctgtttcaagtatggaactgcataatggttcagtttgtatataagataataacttttttattgaaaaacttgtgaaggggaaagtcttgctatatccttgagccaggaatcaaggtctccattgttatcctagccccatagatgtttttacttagccctaagtttctaaagttttatgtagggttaatatgcagtacagtaatgaggcaggaatttgaatattttcttcattattggaaatgagtcttgtaatttaaagacaaaagcttgttttgagaagtaatattcatatacctgctgtaactgtgaatgtcactgctcttttctggttgtgctttgccacaaattttattgtgaattgtaaaga

SEQ ID NO: 42978 - DNA, 342 bp, Homo sapiens
  misc_feature 267, 322, 332: n = A,T,C or G
tagcgggagggcgaaagatggcggcggcagtactgggacagttgggtgcgttatggatacataacctgaggagccgggggaagctggccttggggaaatctaccactgtcggagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagngagagaccataacgtggaattcaggtccaatttatatatagctgagtccaccctnaggacgaggncagggcctga

SEQ ID NO: 42979 - DNA, 248 bp, Homo sapiens
agatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatc

SEQ ID NO: 42980 - DNA, 232 bp, Homo sapiens
tccctatgggtgcctgcagccgcacccagcgagctcccactacaccttagaaggggtggggctcccacaggctccatggagtgtgcagccccagctatgccttcctgctgcagccagcgtgatggcagcagctactgccatcactagcactttgggaggccaaagcaagtgaatcacttgagcccaagagttggagaccagcctgggcaaaatggcgaaaccctgtctgtgc

SEQ ID NO: 42981 - DNA, 384 bp, Homo sapiens
  misc_feature 20: n = A,T,C or G
atttgagggaggaattaatncaaacgaaatcccaccctcgggcctcgttagacaatccgtcaaggaggttcaaatgtgcagtggcttctctacagtcaaattgtacttacatatcctagcttccagtgtctcagaagaaagccaaaagatttttatttaatgaagatttaagcagaaaaacagcaccatcgagtcaatattaaaatcaccagaacaagataatctgaaaaacagagagtcattcatatatcggtcattagagttttacctttatgattaaaattaaaattatgcatattgtgatgtggaggaaagttgactttttgacatttaaataatgacttggtcgttctgtgtatttgcagccattttaatatttgtatg

SEQ ID NO: 42982 - DNA, 277 bp, Homo sapiens
gcagttagtcacgccctgcagggttctgactacgcctgactccttctccacgggggaaaatcctgtgtattctatggcccagtgctgattcctctgaacatagccgctttctccctctgaagtgacttttcccttgccagcctcgggagctgatattatctgtgtcgggacccccggcgctcaccgcccatctcatttcggaggcaggtttgtgggaggcctctctgttcagaggcctaggtctggcctcgatatcttttttaggatggggaggtga

SEQ ID NO: 42983 - DNA, 282 bp, Homo sapiens
gtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctct

SEQ ID NO: 42984 - DNA, 188 bp, Homo sapiens
aaaggaaggcagcagctgcacgtccgaggcttggggaggacccaggaccgtgtgggtttcttacctgcctgagccacctcagggaatcttccagcctaatgcaggcatttctgcacctttggggtcatgctttgtagcagtgtctcccttgcgacctcgcaataaattggccccacggggtgattttg

SEQ ID NO: 42985 - DNA, 467 bp, Homo sapiens
  misc_feature 7: n = A,T,C or G
gtcagcntttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaacca

SEQ ID NO: 42986 - DNA, 113 bp, Homo sapiens
gaccactgtcttaggtcgggtttcctgaaagcagggcctgagatggagattcacgtgcatttgatttttttgagggtgtactctcaggggaaatctgtaggggagtgagtgat

SEQ ID NO: 42987 - DNA, 114 bp, Homo sapiens
gttgacttgtagttcagaggcgtacaactagttggcgattagacttgttatgtgatgttaccagcctgaaatgcgatcaccccataggaaataaagcaggcatctctggacctc

SEQ ID NO: 42988 - DNA, 300 bp, Homo sapiens
acatgaaattgggctgggcacgatggctcgctcctgttatcccagtgctttgggaggctgaggcaagaggatcacttgaggccaggagttccagaccagcctgggtaatgtagcgagaccctgtctctacaagaagataaaaaaattggctgggtgtcgtggtgcgtgcctgtgatcctagctactcgggtggcggaggtgaggggattgcccgaacccgggagtcgaaagctgcagtgagctactgtgatcgtgcctctctactccagcctgggcaatagggtaagatcctgtctctga

SEQ ID NO: 42989 - DNA, 318 bp, Homo sapiens
aaaataagttgtatggtatataatctttgccatccatcctctctttctcaaaaaaatcctagcacaaatggaataataaagttttattaagaagaatcataccatgtatgtttcatgagattttcattctaaataacatataaggaatgagttgcacaataccaaatattttagactgtgttccttctaaataagttgagtgtatttaatgaaagattttctccaattgaaatggaataagaagaaaatattaaaaggtcctttaatttcttatttggttgtttcttggatatagaggaggaagaaaaaataaagtgt

SEQ ID NO: 42990 - DNA, 176 bp, Homo sapiens
gtaacacatgggactgtgctttataacctccaactaaaccatgcaattgtaacttcataggctaaggaagaatgtttccttttaaccaaagctttttcaatcatttaaaaagactttgaattaacctgtcatccttttcagatttctaattgctctaaactattttctttactatt

SEQ ID NO: 42991 - DNA, 464 bp, Homo sapiens
  misc_feature 7, 36: n = A,T,C or G
gacaaangcagacagcaactacaacagaaaaaactnccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccgaagacgacaccaactccccgcaagatgacatcaacaatgccagaattgaaccctacctcaagaatagcagaagccatgctccaaaccaccaccagacctaaccaaactccaaactccaaactagttgaagtaaat

SEQ ID NO: 42992 - DNA, 472 bp, Homo sapiens
aagagggggagcaggaagaggggcagaaggaagaagaagagggggaggagaaagagatagaagaagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctg

SEQ ID NO: 42993 - DNA, 111 bp, Homo sapiens
gtagctggggctgtgttcccactgctctgggatcccttccccaccaggagcagaggccttcctgccacagaactttaatgacagccacatgaagtgtcatccccttgcccc

SEQ ID NO: 42994 - DNA, 277 bp, Homo sapiens
gacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttc

SEQ ID NO: 42995 - DNA, 412 bp, Homo sapiens
tcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatattttg

SEQ ID NO: 42996 - DNA, 187 bp, Homo sapiens
aaactaaaaaagtaaagtgatcatatcttggtttaaatatttaagaattctctgcttgcctccagtgttaaaccactgtaccattgtagacatttactactggttttcataatcacttatttttcatgttaataattctattttcctatattttattgtagttttaaaaataaactaagatttattc

SEQ ID NO: 42997 - DNA, 367 bp, Homo sapiens
gtggtcttggggtccacacctgcagagctaacttactgccagacggcgacttactgtgggccaccctcagtgaaccggggtgtcctcagctggccctacagagcacttctgtgctggggatgagtaggaactctgggcgaggagggtcccagcgccgcccctcgatacagcctggctctgccctctgcccgtacttataccaggtgggatccctgccctgcattgcctggggattggctgggcttgggcccgccctgctgtggaactggatgttttcagggagcccagcctttcctcatgtcaacacagttcacaatatagttttcaaagtacagtttaaaactcaaaagtaaacttttcagcaact

SEQ ID NO: 42998 - DNA, 430 bp, Homo sapiens
attggtttattaaacctcccagtagcccacttaggtagcaactattagtcttattttaccaataaactgggaaccttcccagtgtcacatagctggtaagaagtaaaactcaggtttgaaagtcaaattgtaaaaacagtggtggtgcacatctataatcccagttgtttgggaggctgatgcaggaggattacctgagcccagtcatttgaagctgccataagctgtgatcccgccaccacactccagcctggacacaaagcgagatcctgtctccaaaataactaaaataaataataacaaaaataaaactagaagaaaatatgggtgagttctatataatttgggggtgaaaaaggatttgtgaggcatagcacatatcataggcagaaatcatgaaggaaaagagaaaagatttgaatatgaaaga

SEQ ID NO: 42999 - DNA, 466 bp, Homo sapiens
atggttctttcttaataataaattagaagaagtagaattacagggtcaaaaagtatccattttaaagctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtgggaagaggacggctagcatccccatacctgcatccata

SEQ ID NO: 43000 - DNA, 187 bp, Homo sapiens
cagctcaaaacgcttagcctagcccacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 43001 - DNA, 500 bp, Homo sapiens
  misc_feature 6, 10, 402: n = A,T,C or G
tcggcncttnctggccgggtgcccttgtttcggtgaacggtactacgattgaaggacatgtggttaaatgctattggggtaaagaatctcctgatatgactaaaaacttccaacaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggngtttcttatgtgttccctaaaacaatactttgctttttcctaggttgactatagtcaatggggccaatggagccaagtgtatggaaacccacaacagt

SEQ ID NO: 43002 - DNA, 405 bp, Homo sapiens
gcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttca

SEQ ID NO: 43003 - DNA, 459 bp, Homo sapiens
  misc_feature 39: n = A,T,C or G
tttcatgtaagctgtgctgtttagaaacaacatctcagnactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgcccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattgttctttaattcctacaaggtactcgaaaaccttaagtgaaaaagatttctatctttttatcttagcgcatttatggaaaaaatattaactatcctgaatat

SEQ ID NO: 43004 - DNA, 170 bp, Homo sapiens
  misc_feature 14, 15, 18: n = A,T,C or G
tcttctctaatggnngcnaatatagcattccttttttgaatttctactttatagaattttcttctaataatatatatttatgcttgaaaatctagttttgatctgtcgttttttgtaacaaaatctgtaccgaaattaatttttaaaacatttcctcagatatacctcca

SEQ ID NO: 43005 - DNA, 242 bp, Homo sapiens
agaataggcaaatgttgatggcttagggaagtaggggggataagggatagggaagagctagagtgaatgagtcccagcttgagagactgggagagtttgttcactgagatccagatatagcccaataagatctatacccacctgcttgtgattcttattaagtacgaatactgtctcacctgagtggttgagaaggtgcgcttggataaaatttgcttcactcccatgatttgaggaagcca

SEQ ID NO: 43006 - DNA, 472 bp, Homo sapiens
gaaaatttatgtgatctctatctatatatagatgttaccttgactatggtttattttcctatctttattttcatctacctgctttttacatcttttttaatataccactctattaggtgcattttttaaaaaaattattttattttatttttagagacatagtgagaccccatctctacaaaaaaatgagccatgtgcctttggtcccagcctcccaagtagctgggatgtagatgtattcttaagttgctgtaaatcctatttggaattagatttaattaaataagaaatattaactgaacaacaacctaagtgaagatttttgtaatctgaaatttcactcacaaatgcagctcccatctgtttgaattcagatcagtaattattaataacctagatgttaatgctgactatttggtctatctcatttaattcccaaaacagcctcataagatagataatgctgttacca

SEQ ID NO: 43007 - DNA, 201 bp, Homo sapiens
  misc_feature 7: n = A,T,C or G
gtgaganaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttc

SEQ ID NO: 43008 - DNA, 141 bp, Homo sapiens
aggcagcaaaagagttgatggaaaatggactaaaaaactgacatgtttgaatcagtgctagagggaacagattgtgaattttgtttacagcatccaatatttggatttttttgtaaataaaaaagttatttttttctattg

SEQ ID NO: 43009 - DNA, 240 bp, Homo sapiens
attcctgaaggtttgatttcagacaagacagtgacattaaagagcatgtgatccatttttatttattttgaccaattcttcaagcagggatcatgatttggggtcacattttaagttacataccaactttaaaattcactgttctttttccctttttaaacgctagttcaatactaacccagttggatgtagcaaatatagatacaaaagcagttgtaacagggatagccaactgaaatt

SEQ ID NO: 43010 - DNA, 401 bp, Homo sapiens
  misc_feature 3, 8, 32, 367: n = A,T,C or G
aangaccntgcactggtggggctgaaagaccnagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggcggggcctttgctgtacaggatcccaatgacaagaccaaattctacgcanctggcctggtgtcctgggggccccagtgtgggac

SEQ ID NO: 43011 - DNA, 352 bp, Homo sapiens
  misc_feature 11, 17, 349: n = A,T,C or G
gtttggccttnttttangcctgtgttgcaggtgctgtttgatttttctaaggtatttttagcccttgatcccctttgcttgcgagaggtggggaactgctcactgacagcttctctgtaacctgcagtaccagtggatcgttcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgtngga

SEQ ID NO: 43012 - DNA, 371 bp, Homo sapiens
gctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgc

SEQ ID NO: 43013 - DNA, 313 bp, Homo sapiens
aattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagtt

SEQ ID NO: 43014 - DNA, 470 bp, Homo sapiens
  misc_feature 119: n = A,T,C or G
gagaatgttgatgcctcattctaaagcgatactaaaatggatcgtaaggataagctatttgtgattaacgaggtttgtgaaatgaagaactgtaataaatgcatctattttgaagctangaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatgggtttcggaactttcagatcatagaagaagatgctgctcttgtagaaataggacctcgttttgtct

SEQ ID NO: 43015 - DNA, 394 bp, Homo sapiens
agagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaagc

SEQ ID NO: 43016 - DNA, 319 bp, Homo sapiens
  misc_feature 17: n = A,T,C or G
atatactagcatttacntctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatggcttt

SEQ ID NO: 43017 - DNA, 449 bp, Homo sapiens
  misc_feature 2, 3, 371: n = A,T,C or G
tnngccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctgggggnggggtcattccacacatccacaaatctctgattgggaagaaaggacaacagaagactgttctaaaggatgcctggatt

SEQ ID NO: 43018 - DNA, 492 bp, Homo sapiens
  misc_feature 3, 8: n = A,T,C or G
aanaaagnggtttacactaaatttttgattctgttgtatatatttgcattagtattataagtatcataatgagatttttacggagagcacttttgatggaattttaaatgaatgttttaatgtattattggctggcacagacacacaagtacacaaatcctttagtgtgatggccttgtgcttgttttggtgaaatagtattacttctatgatacatgaaaaaatacctttgcttactttatcggcaaaaggtctttattcttctgcccctggagttaggttaagagtatatttattagccaggtgcagtgtgtctcacgcctgtaatctcagcactttggggggctgaggcccatggattccttgagctcagaggttcgggacctgcctgggcaacacggcgaaaccccgtctctacaaaaaaatacaaaaattggccaggcatggtggcttacacctgtagtcccagctacttgggagaatgaggtagga

SEQ ID NO: 43019 - DNA, 476 bp, Homo sapiens
agtgaattactgtttacaaaatacacatactgtgaacagatataagtttctgtcttttataaggtttgtagaatgagtgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggatttt

SEQ ID NO: 43020 - DNA, 484 bp, Homo sapiens
  misc_feature 3: n = A,T,C or G
ctncatctttggctaccggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacaacaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggac

SEQ ID NO: 43021 - DNA, 299 bp, Homo sapiens
gaaaaataaaaacctaaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtatttttta

SEQ ID NO: 43022 - DNA, 225 bp, Homo sapiens
  misc_feature 225: n = A,T,C or G
atttgcctctgtgttaatatttaaaaccaaaaacatttaatgaatatatcttcaaattcttcaagctgaaattcttaaatccataattaattcaaaaggaattagaagagcagttcaaatcttagttggtagtgctagggatgcattacctgtcctttgccaaaagttactgcttagtattctaactatagtgatttcttgctttatttttagattttaaaggtn

SEQ ID NO: 43023 - DNA, 500 bp, Homo sapiens
  misc_feature 12, 18: n = A,T,C or G
gactttgttgtnaaagtnctccttaaatacacattccattctaatgtagaaggaaacgatctttttgaaagaatatccgttgaaagaaatacatgaatttttgttctaattatttgaaaatccctcctccaatgttttcatatttattgcatacatcacagagtaaataaattatttgccaggacttgaactgcagaacaaaaatgacaaacaaaaattttatgcatactaactttagcacctgccatgtaagactttgcagtattttctccctaaacacacatcacagttactcagaattttagcagatttcagtttgatactctgcagctctgaggactggttcagatgtgtgcgtgtcactctatttggaagtattcgagcataaggattgggaacgggaaaagaagaatgaggatgaccaagtagaaagcatgcttttgcactgttgcgttgatcaatctggacctgaggccagcatcctggtgcctactaggcag

SEQ ID NO: 43024 - DNA, 479 bp, Homo sapiens
  misc_feature 6, 328, 446: n = A,T,C or G
gtaagnattttgagaaaatgtacttgacattttttgcagtaaaaagaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttanatatacaagttgttaggccgggtgcgatggctcgcacctgtaatcccagcgctttggggggctgaggcgggcggatcgcttgagctcaggagttcgagaccagcctggacggcgtggnggaaccctgtctctcccaggaatacaaaaattg

SEQ ID NO: 43025 - DNA, 435 bp, Homo sapiens
atgctttgaaatcctagccttcctgtggatgatttaattctgatttttggagatatgttgtgatctcataaaaaatctattggcacaaacacagaatgggggtgaaaaaaattgaataggaaataaaagaggtggaaatgaatttctaatgagatacatctttgtatcaactgtggtcgctttccaaaagaaatgtgctctaaatgtgcttccatttgtatattaatatttattgagcatctactatatgtcaggtaccattccagatgattgggaaacaacagtgaagaaatagagtcctatccccctaccctcctatactgcagtgttgggaaagcaggaaacactgaacctaataaggaagtaaatgatacggtatggttaggaagcataagtactattgaaattgaacacatagaacaataaccttttgga

SEQ ID NO: 43026 - DNA, 249 bp, Homo sapiens
  misc_feature 6, 7: n = A,T,C or G
catggnntgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaaca

SEQ ID NO: 43027 - DNA, 360 bp, Homo sapiens
cacaatagctcctcctgacacaatggtatgcagcagttttgtgggggctgtgaatgttgggagggagtgctttgtgaggtgagggagagactgattctgagagcccagggagaagatgggtgtgtgtgtgtttcaggggatggggtgtgatgagattattaggagcacccagggcccaggctcaaggagacacttctcatgtccctgtggccttttgaagctgaagatgagcagagcaggtgggcactggtgtcagcccagcgccttcaggagggtgctctttcaaaatcaatggagggcacagtgctttttttccagagaacagcattgacttccccacccatgggtctggtacataat

SEQ ID NO: 43028 - DNA, 469 bp, Homo sapiens
tcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtgggtggctaacctgaccaataaagttattttatga

SEQ ID NO: 43029 - DNA, 148 bp, Homo sapiens
  misc_feature 9, 64, 70, 73, 80: n = A,T,C or G
cttgaagangaggccgcctcctcggggctccaggctggcttgcccgcgctctttcttccctcgngacagnggngtgtggngtcgtctgtgaatgctaagtccatcaccctttccggcacactgccaaataaacagctatttaaggggg

SEQ ID NO: 43030 - DNA, 298 bp, Homo sapiens
agagatagcaaagtgaaacccccgtctcaactaaaaatacaaaaattagacagtcatggtggcatgctcctgtaatcccagctactcacgaggctgaggcaggagaatcacttgaacccgggaagctgaggttgcagtgagccagatcgtgccattgcactccagcctgggcgacagagcaactttccatctgaaaaacaaaaacagaaaaaaagaaaattcccaaccagttcatcctagtccacaagaatctgatttttgtctcccttgtcctttaattactcttccttgtctcctt

SEQ ID NO: 43031 - DNA, 384 bp, Homo sapiens
cttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgatttttaaatgggaattttgcacataatacattgtaatacctgtatgataatcatgtgtgaaaataatttttgaaatat

SEQ ID NO: 43032 - DNA, 389 bp, Homo sapiens
  misc_feature 378: n = A,T,C or G
agtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttccgngggaacaactg

SEQ ID NO: 43033 - DNA, 301 bp, Homo sapiens
catctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttg

SEQ ID NO: 43034 - DNA, 365 bp, Homo sapiens
  misc_feature 3, 33, 58: n = A,T,C or G
gantccgcaaacttttcatctctctaagaagangatgtccgccagtatgttgtaaganagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataaggatcagact

SEQ ID NO: 43035 - DNA, 457 bp, Homo sapiens
gaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatgggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataata

SEQ ID NO: 43036 - DNA, 463 bp, Homo sapiens
  misc_feature 402, 454: n = A,T,C or G
tcccccttctagtgatctcactgtaacttgagcatattcctcctattttatcaattacagaagtatgtaaaattttcggctgggcacagtggcttatgcctgtaatcctagcactttgggaggccaaggcgggaggatggctcgagcccggaagttcaaggctgcagtgagctatgatcatgctactgcactccatcctgggcaacagtgagaccctgtgtctaaaaaaatagtaataataaaaataaataaaaatactatacaaaaagttcctaagcaacttgaaggttaatcttaactcatatttttgtatcctagagcacaaatcattctttcaataaaactttgagaatttaatgtatgttaggtaccaacacctcaaatagaaagctcttaatcaanactcactctttaagcttatcatgaagtaataggtatctaaaccctttataanacaagtatt

SEQ ID NO: 43037 - DNA, 234 bp, Homo sapiens
atgaaggggaaacactaatttggaaggatcatgagttgtttccacaacagtatcctgctctggccctaaataaccatgtatacacttcttcccaaacatagaacataatgggacctttcccaggggagccaacccacagtcaaggaatcattgcactcagctcatggtcagggatttctgagtaaagcactgtcctgcctaaaggtcagtatgtgactccttgtggtctcatac

SEQ ID NO: 43038 - DNA, 226 bp, Homo sapiens
cgaggcaggtagattgcttgagcccaggagtttgagaccagcctgggcaacatggcaaaaccctgtctttacttaaaatacaaacaaatgggcatggtggcacgtggctgtagtctcagctactcgggaggctgagtttgggggaatcacctgaacttgggacgttgaggctgcagtaagccgagatggtgccatggcataatagcctgggggagaacgctgtccc

SEQ ID NO: 43039 - DNA, 448 bp, Homo sapiens
  misc_feature 25: n = A,T,C or G
caggtacatacatttttcctttgcnagatatctaaccaatagaattattcattaaatcaggaggtttgactcatatcaagtcattcttagagccagaaatcagcaatatttggcctgccttcctgtcctggggcatgtctctagcaactttgatcttaatgatcaggattattcccttgaaggattcttccttgtctcaggaatagatttactttcttattgttggttaattgaatcctgaaagtattaagtattagtatgcttctctttgtgtcaagaaattgttcttacatctttacagccataagtgtggctctgtcattgttctttgttatttttgattttgctgctacctatagaactcttgttaaatgtaaggaaatttctggagttatccccatatttcagaagctctgaaaggttagcaaagatattaagaattttagag

SEQ ID NO: 43040 - DNA, 463 bp, Homo sapiens
  misc_feature 203: n = A,T,C or G
tacacttttgggctttgggtttatactgcgagcctttttttttgtttttcttgtatgtatacctaagtagtcctatgttttcacatggtcagagttttgataataatactctacctagcttctgaacagtttaataatagatttaatccgtgagaggaaataccctcgaaagttactatagaaataacaccttactatctggnggcatttacttagttcttagaactgactaattagtttatcggttaaagtaatttgctattatattgtaaaatagtacatttgaggctcacttataaaaattggaaaacatcgaaatataagaggtccaagagggtgtttgaaacacattttgctaagttgacaggaaattaatagacttttttatgggccattaactaataatacactcaaaaaaaaggtacagttaaataaaggttttaaatagtctataccgtatact

SEQ ID NO: 43041 - DNA, 473 bp, Homo sapiens
  misc_feature 447, 463: n = A,T,C or G
gacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcanaaagtggtggctgggngtggctaatg

SEQ ID NO: 43042 - DNA, 472 bp, Homo sapiens
gtttatagtagccgcaataagtagtgcaagtaacaaaaacacagcaaacttaggcaaagtgtcctttctttgagatgcgagttctttcatgaggttttctttagggccagagttacctaaagtgaagcctttcttatctatagacttcagattctgcttggaatcccaccggctcaagaagcacatgtattgtgcaattaattgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagttt

SEQ ID NO: 43043 - DNA, 254 bp, Homo sapiens
acggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggaagtatggtt

SEQ ID NO: 43044 - DNA, 411 bp, Homo sapiens
catacgcagtggctcacacatataatgggaggtcaaggcaagacgatcatttgagcccagcagttcaagaccagtctgggccacatagcaagaccccaactctacaaaaaactttaaaaattagccaggcatggtggcatgctcctgtagtcccgactactcaagaggctgaggtgagaggatcacttgagcccaggaattcgaggctatagtgagctatgatcatgccactgccctccagcctgggtgacagcaagaccctgtctctaaaaaattaaaaattaagaaataaacttaatacctaaatatctttattcagtcaaattgttattcaaatgtgagaccataaaaaaatatattctcatacaaacacagcttcagaggcttagcaaaaaaaaagtgtccttttct

SEQ ID NO: 43045 - DNA, 472 bp, Homo sapiens
agataattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaatttttaagt

SEQ ID NO: 43046 - DNA, 304 bp, Homo sapiens
  misc_feature 14, 280, 286, 297: n = A,T,C or G
tgtaattaattttntggctcttgcgaagaagaatttttgtggtgattaaaatagtcccttgcacatattaggtactcagtaagcatttgtgaaatagggactttctagcctttatttgtgtttaaggaatcagggaataagttcaaaattgcctttcaagaaatttttggaactctcttctcactaagaaactgtaaagtcttataaaagagacattatttattttctccaagtattgcttgcgaggtgaattgaaggttttttttttttatcaacagtngttttntaaaatcgttngaggact

SEQ ID NO: 43047 - DNA, 313 bp, Homo sapiens
catctttctctgctcatcttcacgctgccttctcttctgtgtgtctgtgtcttctccagtctgggtttcttcaccacctctcttttataagtacttgtcattggagttagggcccacctgagttatctagaatcatctcctttatttcaagatccttagcacatctgcaaagacccttttcccaaataaggtcacattcataggttccagggatttgatgtgtatatcctctggtggtcattttttggcctaccacagttaaaatgactattatataaaatattactaaaatatattacttattttgaaattc

SEQ ID NO: 43048 - DNA, 377 bp, Homo sapiens
  misc_feature 9, 15: n = A,T,C or G
aagccggtncctttnaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttattgtaagtgct

SEQ ID NO: 43049 - DNA, 469 bp, Homo sapiens
gagggcgggtggagtcgcggagtagtcctcatggccgccccgccggagcccgtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatattgaaggtacccacctcgatcctgaaagaaaacacaacggcagcagcagcaattgaacaatcttgagcatagaaaagaagtcaatgtaaacgaagttaagatcaaccacataaaacatttcatgtgcaataagctctcaatcaagtaaataaagttt

SEQ ID NO: 43050 - DNA, 466 bp, Homo sapiens
gaagagaaattactggaaattctctctcctgtcgttaccctaaaaaccagctccagcaaagccatttcacgaacaattatgcatctataatgatctaaataataattggagaaaaatagtattttatggacattaaaatctcaattaatactattgcgactattgaatcaaatataaattgaattaaatttttaaattcaacagaaaatagcaaattggttactagaatattttgtctctaccaatttcactattacttctgaggtgtaaaccaaatataatactggcataaagaaggaaaaatatctcaagatttctaggcattttcctatgtctaatagtaaaggatgttctctctgaatttatttattacaaaaataacattacaacaataaagcaaaataatatttaaaagaaagaaaaaacaaacagtcgcaataccagaacaccattgtagtcgtttgtg

SEQ ID NO: 43051 - DNA, 470 bp, Homo sapiens
  misc_feature 5, 7, 10, 11, 15, 17, 27, 35, 37, 40, 44, 45, 46, 47, 49,61, 62, 66, 68, 72, 73, 107, 111, 122: n = A,T,C or G
atttntngannctgngnagtggaggtngctgtgantnaanattnnnncnacctgccactannagtntnaagnnactgatcgagtactgcatcacacacacacgaaangagngtaactgcagnagccccgaattgtaagccaggatacttcaccaaagaaacataaaatataaacacccaccccccaactcttcaactcattatcagtgacttctatcagactcttgaatatgcacccttgggaaatggagtaagaaccatagcttaaatcgtttaaactcatatgggacaaaacgatgaaaatatgcaagagggaacaatcttacattggaaaagaaatcaagccaatgacccaatatatctttttattatttcttgggagaacctgtatgtttaattcatggaattcttcactgtttctatgttgaaatacacttatgtgaaaattgcactcctattaataaaatagga

SEQ ID NO: 43052 - DNA, 470 bp, Homo sapiens
agtaaaacataggaaaaggctcacatctggaatcacagcactttgggaggttgaggagggtggattatctgaggttaagcgtccaagaccagcctggccaacatggtgaaatcctgtctctactaaaaatacaaagaaaattagctaggcatggtggtgcacacctgtaattccagctatttgggaggctgaggcatgagaatcgcctgaacctgggaggcggaggttgcagtgagctgagatcgtgccactgccttccagcctgggtgacagagcaagactccgtcaaaaaagaaaaatggaatatatgaagggaataaactctttttgactaagaaagttttatcccagcatgagaatggttttaagatcgtggaaagttattcatagaatgcattagatgtaatggagaaccaaaagttaaaatccaaaggtgtttgaaaacaattacatgctccttttaagaatag

SEQ ID NO: 43053 - DNA, 473 bp, Homo sapiens
  misc_feature 401, 402: n = A,T,C or G
attcagatgtcggatgatattctgagagagagagacagtaggccataatagccttggccatagttttggcccatagggtgtttatgggtaggatagcccgataaagatgtcacttttccccctaattgatttataaattcagtgaaactttaaccaaaatcccaaaggaatttttgtatgaatttgagaagcctataaagtttgtttggtatgtaactataacaaggacagtttaaaaaaacgagacttatcccaccagctattaaaatttagaaactactatagttaaaattttgcaattattagcaaaagaacaaatagataaaattagagaacccagccttgtgacagtgattcttatctcatagtgcaaaagatggcatttggttgggagataatanntcaaaaaaaagttcctttctacagcaactcacaatttgaggaccatagttctaagaaatatccacaaagtc

SEQ ID NO: 43054 - DNA, 469 bp, Homo sapiens
  misc_feature 452: n = A,T,C or G
tcccaccctcctgagccccaacttctccatggaagaaggttcccctccctcagagatattggagcttgtcaccacctgctgacattgcagtcattaccactgcttggttggcaggatttctaggtgcctggggcactagagaatggagaacaaaagagaagaaattggcagatttctcccacactctctgagtattaggagatgcttttcctgctccttgagccagaactagagggcttctcctggggctctgtctgtctgtgcgtattctgagtttcagactgccttatttctagactgaggttctgatagggaaaaaacaaaaacagaaaactcactgcttgttcagtagtactttaaattctagtctttttccccaattcacttggtactttttatctttcagtgtccccaagtagctgtttcatgcattctatctaggttttataacntatttaatggaaaaaga

SEQ ID NO: 43055 - DNA, 304 bp, Homo sapiens
caccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccaac

SEQ ID NO: 43056 - DNA, 104 bp, Homo sapiens
gacctgcataatttgtggttggggagaggggaccgatgtgcctcattgtttagtggtgattacaaatatgcttttctggataaagtttggttgtttgctcttgg

SEQ ID NO: 43057 - DNA, 467 bp, Homo sapiens
gaatatggactgggtattgaaaagccctatggaattattattcttttttttagttgtgataatgacatggtgaccatgtttaagggtaaatgttccttattggttagagaagcctaatgcagtgtgtagaaatgacctgatgtctgggctgaggttaggattgggggagaaggaccagaaagatcagggcctctcccctgagacccaagcaagcagctggccaccccctatcacccaaattgactatctagggagtgaaccatgctccctctgcacagggctgacagtttggggtatttctttaaaatgcctaaaatttgtacgtcaccaaggcaaggcatgaggcaggaaaatttgccaacatggccccctggggagttggccctggttgatccatctcacccccttcctttcccataatacctgttcactcaattcatagctaagattgccaccaatattattac

SEQ ID NO: 43058 - DNA, 303 bp, Homo sapiens
  misc_feature 13: n = A,T,C or G
cgtctgcgaaatntatggctgtagcattcgtgctatccctgggggttgcagctttgtataagtctcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaac

SEQ ID NO: 43059 - DNA, 319 bp, Homo sapiens
cagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttataggaagtccaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaagc

SEQ ID NO: 43060 - DNA, 287 bp, Homo sapiens
atcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttct

SEQ ID NO: 43061 - DNA, 461 bp, Homo sapiens
  misc_feature 438, 441: n = A,T,C or G
atagtctcaagattttaagtaatgaatatttgctgcttttgtaacaaggaaaaaaaagatttttttttaattaaaaacttactgtctttaggcctctaaagcagattcccaaacttatataccttctgttaatttgtttcaaattgtactaggttggaaaaattttttaatgcttacacatagtaagggcacttcaatagaagaatgctaatgcattcaggattacaaatattattttgtaattttcttaagtatggtacttaaggaaattttcttcttccaggggaaaaaaagagtatgttttaaaagtagctttaaaacataactgaaaacttactgaacaactagcactgaatctgaaggtgttacaaattgctgtttcataaatacattggtaattttacctgccaccatgtgccttctccctcaggagcttanaanaggcagggtggttaattctt

SEQ ID NO: 43062 - DNA, 204 bp, Homo sapiens
  misc_feature 184, 187: n = A,T,C or G
gactgagagtgggggatgagaaacgaactccgtcccctgcacagtcagtgccttcgggggctccaccaccgcgcgctcccaccctcaaggtctgcaggacacaccaaagaactcctccaagtcacacaagggagaaaattaacttcattggcttctatcaggaaagctatttttttttttcctnttntttcctgcaagtttccc

SEQ ID NO: 43063 - DNA, 464 bp, Homo sapiens
agtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttccctcttgttctaatcttgtc

SEQ ID NO: 43064 - DNA, 472 bp, Homo sapiens
  misc_feature 3: n = A,T,C or G
atncatagagcccagtatttacccaccaatcctcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaatt

SEQ ID NO: 43065 - DNA, 471 bp, Homo sapiens
atgtagttgaatttagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatg

SEQ ID NO: 43066 - DNA, 205 bp, Homo sapiens
  misc_feature 34: n = A,T,C or G
caggtaatgattaggttccttagtatagtttacnactgtacatgtgccacctagtggatggagattatccgtagatagtggctacagatgaaatcgccttgcctgtccttatcccagggttgcagttgtccccacctttctgactttggtgcattttgtgaccaagtgtcattgcctgtattttaggtcaggttcaaagtaaggg

SEQ ID NO: 43067 - DNA, 459 bp, Homo sapiens
cataaaagacagatgtccccagagcagccatttcagaggcctacccctgggaacgcattctctttctcagggatgtcccttgctgagaaaaagaattcagcaatatttctcctatttgcttttgaaagaaaagaaatatggctctgttccgtctggctctcaggcagccagacctaatggttatctcccttgttccctgaacatcactgttatcctgttcttttttcaaggtgcccacatttcatattgtttaaacaatttgtgcagttaacgcaatcatcacagggtcctgaggtgacatacatcctcagcttacgaagatgacaggattacgagattaaagtaaagacaggcataggaaatcacaagaatattgattggggggaagtgattaagtgtccatgaaatcttcacaatttatgttcagagatggcagtaaagacaggcataagaaattat

SEQ ID NO: 43068 - DNA, 470 bp, Homo sapiens
aggccataaccctgcagtgtcctctgtgggtcatgtgaaaggaagggttacatgtctcactttacaatagctagaaatgattaagctttgcaaggaacgtgttagccaagttgtgaatgcaaaggaaaagtttttgaaggaaattaaaagggctgctccagtgaacacatgataagattatactaagatattttttgcccctattttgtatacattttcgccaactgtgaaaatgtaaactgtaattgtaaattaaaaaaaggtttttttccgtagagatggggtcttaccatgttgcccgggttggtctagaactcctggccttaggtgttccttttgcctcagcctctcaaaatgctaggattacaggcataagcaaagtgacttgcacaattgatttgctgctggcaccttagcacaaatcaaggttagtggtaccaaaccgagctaataataacgattgagttttt

SEQ ID NO: 43069 - DNA, 221 bp, Homo sapiens
  misc_feature 11: n = A,T,C or G
atagttctttnccagtaaattgtggcagttgatagcaaaatggagagaacatttttattcttaggcaaagagaaaaaacatttctagtgacattttacaaatattccgtaaatggaggctactcattttggctataaaattttggttagatttaaataaaaaattatgcttgtattttaaaacataaatacatgagtaaagtaaatatataagaaattagc

SEQ ID NO: 43070 - DNA, 337 bp, Homo sapiens
  misc_feature 60, 70: n = A,T,C or G
gccgtgttagttaggaaattatttattaatttacaaggcaggttttatctcagccaaggngggaaatggngtccctgtccctcccaaagcacagagcacagaaatgaggctgtttacatcgcgagtctctgcgctggtgtttaagtcattaaaaagatattcgaaaaaagaagtctctaaatacaggtttatggaatatttcataacagctttaaggaactatcatggtacactgggaaagtcacccatattgcaggatagatttcttctggtggctgacgagcatttgtttataagtcggccttgactctactctaccacaatttatatgtagttc

SEQ ID NO: 43071 - DNA, 315 bp, Homo sapiens
gttctaagattagttgaaatgttccagcagcttagtagcataaccacaagacagtgttgggtttgccaggtaatatacagtatactaaaaatacaaagagtattttacttataatatttttaacaaataatttttaggataagtatatcccatgtgatatactttgggacatacttatactaaaaataattcattgtttggctgggcatgctggcttacacttgtaatcccagcactttgggaggctgaggtaggcggatcatgaggtcagaagatcgagaccatcctagctaatatggtgaaaccctgtctcta

SEQ ID NO: 43072 - DNA, 185 bp, Homo sapiens
caggcaactgacacactcctgtctgttcacaccttctctctgaggagctgtggttctcagcttctgtgccaggcatggtggctcgcgcctataatcccaacactttgggaggcagaggcagaagaatcacttgagcccagcagtttgagaccagcctaggctacatagtaagatctcatctctac

SEQ ID NO: 43073 - DNA, 302 bp, Homo sapiens
  misc_feature 201: n = A,T,C or G
agccagcccgctgctcactttcaccctctctcccctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggngggaggaagcaaaagactctgtacctattttgtatgtgtataataatttgagatgtttttaattattttgattgctggaataaagcatgtggaaatgacgc

SEQ ID NO: 43074 - DNA, 176 bp, Homo sapiens
  misc_feature 17, 25, 34: n = A,T,C or G
accccgggaattcggcnttatggcnggagtttcnatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaaccca

SEQ ID NO: 43075 - DNA, 404 bp, Homo sapiens
  misc_feature 210, 272, 353, 362, 371: n = A,T,C or G
atcctagactcattgcccaggaggaggactatgaacattccaaatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaagactatnaacattccacatgaagaaaaactgtggctcctagactcattgcccagaggaggactatgaanattccacatgaagaaaaacagtggctcctagactcattgcccagaggaagactatgaacattccaaatgaagaaaaacagnggctcctanactcattgnccagaggaagactatgaacattccaaatgaaga

SEQ ID NO: 43076 - DNA, 470 bp, Homo sapiens
agcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccactatgagctgcccactgatgacgacacttatgaggagcacagacgagataaggctcgaaaacagcagcagcaacaccgactg

SEQ ID NO: 43077 - DNA, 162 bp, Homo sapiens; identical to SEQ ID NO: 29072

SEQ ID NO: 43078 - DNA, 380 bp, Homo sapiens
  misc_feature 3, 31: n = A,T,C or G
gtnctagtaaaatagaccctgtctccttgtnctttcaatttattcttcatatcttaataaaaagtggcctgggggaatttgataacagagtatagttgtggccaagtttcccatggcagttagcttggaacaaactcttaacacaatgagcattaaacacttatgcttttgaatgtttgaaaaaggttgaaggcccaagttttgcaagtcctgcataatggaccagattttgcatgaaatatcttttaatatgtcactttttgttaaataacatcagacccctgtatgcagtcagtaaagtaacattaagaaggaataggctgctctgtctatggagcagccattcttttgtttcttctctaataaactggctttcactt

SEQ ID NO: 43079 - DNA, 472 bp, Homo sapiens
tctgcacagcaaaggaaactatcaacacagtaaacagacaactcacagaatggaagaaaatatttgcaaactatgcatctgacaaaggtctagtatccagaatttacaaggaacttaaattaacaagcaaaacacaaacaatcccattaaagaatgggcaaaggaaatgaacagacatttttttaaaagaagatataaatgcagcaacaatcatgaaaaatgctcaccatcattaatcattagagaaatacaaatcaaaaccacaatgtgataccatcttgcaccagtcagaatggctattgttaaagtcaaaaaataacagatgccagtgaagctgcagaaaaaaagggaatgtttatacactgtaggtgggaatgtaaattagttcagccactgtggaaatcagttggcgatctctcaaagaacttaaaacagagctaccttttcacccagcaaccccattattgggtat

SEQ ID NO: 43080 - DNA, 187 bp, Homo sapiens
caccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcg

SEQ ID NO: 43081 - DNA, 262 bp, Homo sapiens
atagaagaggtgatatgttctttacggattgcttgacagataacagtgtttgaccagacaaattcagttacagatatacctgtagaaagagttgaaaacatcaatgaagcctgtaagtaacttcaaatgaactgaatatttagatttatcacctgtttaaagatacctgatggagatattgcaagtaatactaaaattaaatttcttaaaaagctttatttcttaatattctcttattctatttatacttttggaatccccc

SEQ ID NO: 43082 - DNA, 442 bp, Homo sapiens
cattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtga

SEQ ID NO: 43083 - DNA, 345 bp, Homo sapiens
gtaccaaacactgccttggcgaagtgacccttaatggaggtaggtaaaagatcagctgtcatgtctgtgcttcttccatattagagagtgtggtgatgtaattttagtcagggtttttggttttggttttggttcagatatttcagacacagtctaaagtaaattatggccagtgtttgttctactttacaatagaaaagcatccatggagttttgataacagtcaaagaccctttcatgatctttacatggtgagcagctagtattgaaaacttgggtagccataatttatttcccagttttattatcttatattcttatcctagtttgcccagaaatgtggat

SEQ ID NO: 43084 - DNA, 397 bp, Homo sapiens
agattctgaggggtttagtctcctggacttttagctgcatatttccagaccttactcttttatagagaagtctacctacctcaaagtcagctaatccatgaaatgactaccaaatagaattcagccttttttatgaggcaatatgtaggccagctaaaagggagggggggcacctattttagtccaaagataaatgtcactttgaaagaaatttgctgaagatatttgtgggtttctttgagttttaaaaagttatttaaaagaaatcaggctgggcgtggtggctcatgcccgtaatcccagcactttgggaggccaaagcaggtggatcagttgaggtcaggagcttgagaccagcctggccaacatggtgaaacactgtctctactaaaaatac

SEQ ID NO: 43085 - DNA, 167 bp, Homo sapiens
  misc_feature 9, 14: n = A,T,C or G
tgccttttngaatntcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgt

SEQ ID NO: 43086 - DNA, 435 bp, Homo sapiens
gtatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactac

SEQ ID NO: 43087 - DNA, 418 bp, Homo sapiens
aactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaaga

SEQ ID NO: 43088 - DNA, 362 bp, Homo sapiens
gttttaagaggaaatggaagactaaggttgttttaaggagtacaactctgaattccttttgcttttttaccttacagtttttctctagcaaggacggtggcagcaagtgaaagggaagatgtgttttcaggatccgtggtgagggcattgcatgagcttgttccaaacctgcaaaactggttttcgatcaatttctacgatttttttttctctatttgcttccaagtcttgctgcttccattattactactacaattcaaagcatctataagaacattgtaactgtagatctggtgtgagggaatacgtctagcctatgaatagatgttttgactagaacaattcctaaccataacagtcat

SEQ ID NO: 43089 - DNA, 422 bp, Homo sapiens
atacagatgggacttgccgactctcggaagtacttgactctggcaagcctgaggaaggaattaaccagaactgagagaagctgttaagataaatgaaaagtcactgaaaatatggactgaactgcacccaagtccttttggagagtagaagaatttggctgaatttagagttttcgcaattttacatatgaatggtgcatgtgggactcatgaggcgtacagcccagtgttggacagctgagatctaactcattgcagttctcctgggaacgttgcaagatttactgtgattagttaagcctcatagtcagaagcccaaaatatgacccacccagtttatttcataattattgcatctctagggctttattttttaaaaagctttttttcttatatgcactttctactgtttttgtttgttg

SEQ ID NO: 43090 - DNA, 406 bp, Homo sapiens
  misc_feature 48, 66, 87, 121, 126: n = A,T,C or G
aagatgaggtctgtgtatgctcacttccccatcaacgttgttatccangagaatgggtctcttgtngaaatccgaaatttcttgggngaaaaatacatccgcagggttcggatgagaccangtgtngcttgttcagtatctcaagcccagaaagatgaattaatccttgaaggaaatgacattgagcttgtttcaaattcagcggctttgattcagcaagccacaacagttaaaaacaaggatatcaggaaatttttgaatggtatctatgtctctgaaaaaggaactgttcagcaggctgatgaataagatctaagagttacctggctacagaaagaagatgccagatgacacttaagacctacttgtgatatttaaatgatgcaataaaagacctattgatttg

SEQ ID NO: 43091 - DNA, 252 bp, Homo sapiens
  misc_feature 144, 177, 181, 197, 213, 220, 241: n = A,T,C or G
tttcccagataaaaagctaagctgtatggtgtctactgcttcagagcatacaactgaatgtgcccttagagcgcatcagttttaaagtcattaagaacatgtgaaaggtgtttttttttttccaatatgaactcatgcaagttnccaaaactgggataacccttttttacttactgnaaanagtcattttcataaanatcaattcattgattngtttttngtaaagctatcattcaatatntattataaatt

SEQ ID NO: 43092 - DNA, 451 bp, Homo sapiens
atcgactcttacattttctcctttattggatttgcagataagagctacaaattcaaatctgtttggttctaaagtccgttttgttttcatgacaccacaataaaaacaacaatctcacaaataatgaaaactaacatttactgaatatttactttctacagaaaccatactttgccaggcatggtggctcacgcctataattccagcactttgtgaggccgaggcgagcagatcacttgaggccaggagtttgagaccagcctggccaacatggcaaaaccctgtctcaactgaaaatacaaaaattagctgggcatggaggtgggcacctgtaatcccggctactcaggagactgagacaggagaatcagttgaacccaggaaacagaggttgcagtgagccgagatcataccactgcactccagcctgggcaacagagcaaaactccat

SEQ ID NO: 43093 - DNA, 341 bp, Homo sapiens
  misc_feature 7, 184, 207, 212, 220, 323: n = A,T,C or G
gagagcnttttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaanaagtaggtgtgtggccttttcanaaggnggcatggncctcaagtgagttcttagtattttatatcagcaaaataattcaattttgcaggttgcaaacaaatataaaacctgtttctgtttatgaatattattcttttanaatagaataagtacatgc

SEQ ID NO: 43094 - DNA, 247 bp, Homo sapiens
catctggcaggtgcccctctgggatgaagcttccagaggaaggatcaggcaaaagtctttgctgttctgcattctctgccagtgatagccaggcaaacagggtctggagtggacctccagcaaataccagcagacctgcagcagaggggtctgactgttagaaggaaaactaacaaacagaaaggaatagcatcaacatcaacggaaacgacgtccacacagaaacccaatccgaaggtcaccaaca

SEQ ID NO: 43095 - DNA, 471 bp, Homo sapiens
  misc_feature 18: n = A,T,C or G
attgtgtctgcattggtnaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatttttaagcagggcctat

SEQ ID NO: 43096 - DNA, 404 bp, Homo sapiens
aacctagaggcaatatagcttaagtagcaaaatatttttttacagtaagcttcagtcatccatagtcactataagttggttatcatctgaaatggttagaaccagaattgtttcaaacttggggggttttcggattttggaatatagtcaagcatggcttaaccacagggatgtgttctgagaaatgcgctgtcaggcagtttttcctgtgaacaccatgtgtacctacatggacctaaaaaacaggtggtggagcctcctccacacctaggctatatggtgtatgtagcctgttgctctagactggagggcacgttactgtactgatactgtaggcaactgttaacacaatggtatctgtgtatctgaacataacatagtaaaggtacagtgcaaactgtgtt

SEQ ID NO: 43097 - DNA, 206 bp, Homo sapiens
  misc_feature 24, 26: n = A,T,C or G
gagcatgaacttgcaggaaagaanantccgggagcagcacgggaagctgaaatcagccaaagaagagcagaggaaactggctttccattttgtgttttcttgatagattgctgaacaacttttgtacgaacactggaaaaagaacaacccgaaacttcgagagatggagctggaccttcaccagaagcatgtcgtaaactcttggg

SEQ ID NO: 43098 - DNA, 460 bp, Homo sapiens
  misc_feature 448: n = A,T,C or G
gagtacggtgtgtttctgagagagtgtgatgttcacctctgtagcatatggaaactttttctttttttctttttcttccagagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatggggtggcctgtggtatatgggaaaaggtagcanggggtggtcaag

SEQ ID NO: 43099 - DNA, 466 bp, Homo sapiens
ggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactac

SEQ ID NO: 43100 - DNA, 448 bp, Homo sapiens
ctggctgttcatcagaattaaaaaatcgaatggaatatgccctgaacatgctcttacaaagatgtaactgaaagacttttcgaatggaccctatgggactcctcttttccactgtgagatctacagggaacccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggaggggagaaagggaggaagctcccatgttgttt

SEQ ID NO: 43101 - DNA, 434 bp, Homo sapiens
  misc_feature 2: n = A,T,C or G
cnttaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaagggatgatgtcttccttagtgttccttgcattttgggacagaatggaatctcagaccttgtgaaggtgactctgacttctgaggaagaggcccgtttgaagaagagtgcagatacactttgggggat

SEQ ID NO: 43102 - DNA, 356 bp, Homo sapiens
agggtgagtggcttgcttggtgggacctgacgagttggtggcatgggaaggatgtgggtctctagtgccttgccctggcttagctgcaggagaagatggctgccttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgtt

SEQ ID NO: 43103 - DNA, 363 bp, Homo sapiens
attccgtgactaaattctgtaattggagttctttgaagataaatcctgagtaatgactccatgtattgtagattatttttaagccattagaaaagtttgaagctcatcagcaaaagcaccgagtctatatgtgaccaagccctcaaatccaaatgactgactcatactcttgtcatgttaaatgctttatacttaagaatacttggaaaatatttttaaaggaattatttcagaaaaagagagctcaaagatagaatatctctgcttgctgtcttctttttcaattacttttacttcagacttattttccacagcacacaaatgtatgtcttattaattgtgcagttattatgaaaagtagtt

SEQ ID NO: 43104 - DNA, 405 bp, Homo sapiens
aaaagaaccttgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattg

SEQ ID NO: 43105 - DNA, 323 bp, Homo sapiens
  misc_feature 306: n = A,T,C or G
gttggcccattgttacatcatctctgtgccttggcttcctggttttaagcctctgttgggaacctgggctctcaggcagatgggattgggtacttttgctacttgctgaataactcttggccagtgactttatgtctggacctcagtttattcatgtgaaaaatggacatgatagcaatagtcattagatggtagggttttgatttgggggttggaagagatgctgtgtatagtgtatgggcctaaagtaggcactccatgcatgagaactagcatcactgttcattaatttttaatttattttangatggtctagtctatgc

SEQ ID NO: 43106 - DNA, 465 bp, Homo sapiens
actgattttccccggacctgccgcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgcttggtttgtagac

SEQ ID NO: 43107 - DNA, 326 bp, Homo sapiens
atagggggatggtttcgggatgaaactgttcccactcagatcatcaggcattagagtctcaggaggagcgtgcagcctccatccctcgcgtgtgccgttcacagtggggttcatgcttctgtgagaatcgtatgctgccgctgatctgtcggggcagagcttggtggggatgcttgttcgcctgctgcttgcgtcctgctgtgcagcctggttcctaacaggccacggaccagtactgccccggggttgcagacccattgtaaaggataattgccaagaatacagatgagggcaagcacggaacaaggtgtggggggggacaggct

SEQ ID NO: 43108 - DNA, 129 bp, Homo sapiens
gtacagaagttttagtgtcttgtgccttgactgtcaagaaacagccacaaagaggtttctgtttcgtgtggtaatgataatcagaacaaatcgattgtaattcctcaattttgtcaagggaacttctcg

SEQ ID NO: 43109 - DNA, 259 bp, Homo sapiens
  misc_feature 258: n = A,T,C or G
gacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtnt

SEQ ID NO: 43110 - DNA, 341 bp, Homo sapiens
gatcgcattgaaaacattgatacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattacct

SEQ ID NO: 43111 - DNA, 465 bp, Homo sapiens
acaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaaagaaggcatatgttcgactggctcctgattacgatgctttggatgttgccaacaaaatt

SEQ ID NO: 43112 - DNA, 248 bp, Homo sapiens
  misc_feature 248: n = A,T,C or G
gaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgtgn

SEQ ID NO: 43113 - DNA, 471 bp, Homo sapiens
  misc_feature 463: n = A,T,C or G
gtaggcccatgggtcccttactagagaggttgagtgaatttgccttcagttaacatgggaccttctgtttaacttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaagggtaagtccattttccccttcaggtcctcagtggattacttaaccactgctgtccctcggtccctttttcctaaacgggtttagttctgtcttttttctccttttttctaaatgctggtaaatatttacattcagccagggaagaangaggccag

SEQ ID NO: 43114 - DNA, 472 bp, Homo sapiens
gagttttgtttctcacgagtgagaactgccaaattggccttaaaatgattagtcctcctgacaacatagaaaatggtgatgttaaatgaaccccaaaccgtgttcccttttctctgttaaaataatgagtttaagattaatcttagtttgtatctttgaggatgttgaatggaactcctagcctttggcagttatcagtggctcgggtgcaatacacaaattctgatctttcacagcccagactgtcttaaacctaatttgaggccatggctaatagaagaggagatgacctatttcggccaaagggtagaaaaatatttgcccaagatgaggggaagatacagtaagaacctgagacaaattgataggaagtgggcttcatctttcctttgctttctgttccattctttaaacgatcaaaattatttcccttcccagttagcccaactgcaaactccattgaacccctgtt

SEQ ID NO: 43115 - DNA, 464 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctggggtttcatccatccgacattgaagttgacttactgaagaatggagagagaattgaaaaagtggagcattcagacttgtctttcagcaggggactggtctttctatctcttgtactacgctgaattcaccccccactgaaaaagatgagtatgcctgccgtgtgaaccatgtgactttgtcacagcccaagatagttaagtggggatcgagacatgtaagcagcatcatggaaggttggaagatgccgcatttggattgggatgaattccaaattctgcttgcttgct

SEQ ID NO: 43116 - DNA, 472 bp, Homo sapiens
  misc_feature 6, 420: n = A,T,C or G
agactntgtaatggattcatttatttgctatttctatgtattgtctgtctttcattactaaatgtagttaaatgtaatacaaggacagaaattgctcactgctgtatctgaagcaccctgaagagtacctggaacatagtagacatttgataaattattgttgaatgaatactgataggcttattactaagttagaagatccttgtcttaatgaataatatagttttaatgtacttcattaatttaaaaatatgaaaagtaagaatgtgattttgtcttatttgtgtttttatagctggcttttcacacattgcagttgttagcatttactgcccttgccattttaattttgaggctaaagctgtttttgacacagcacatgtgtgttatggcttccttgatatgctcttgacgggtaanggattcattcttgtataacaatactataaaaactatagcagctatacttagt

SEQ ID NO: 43117 - DNA, 317 bp, Homo sapiens
aaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctccctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaaggtggccgcagccattgctggctatgtgtttagaga

SEQ ID NO: 43118 - DNA, 374 bp, Homo sapiens
gaagtagcactcaaaagttaattgcatttctatgtactaggaatgagcaattggaatttgaaattttttcgaagtattattttttatagcatagagaaaagaaaatactaagatacaaacctaacaaaatgtgtgcaaggcttaatgccccaaaactatagaatattgatgaaatcaaagatgacctacataaatggagagaaatactctgttcatggattagaagactcagtattgttaagatgccacttctccccaaatggacctgtagattcaatgcaattccgaacaaaatctaagcaggattttttagaaatcaagtgaattctaaaacttgcacaagaatcaaagtacagtagccaaaacaattttgc

SEQ ID NO: 43119 - DNA, 258 bp, Homo sapiens
cattactcactgaccctcttcctgtatatatatatcacctccatcacagaatataccaccttgttaatttaactctaaaatacttctatttccctggaaagtgtcaaagtttttcctgaggtttaaaacaagttatataagatctgagcattcaggccaggtgtggtggctcacagctgtaatcctagcattttgggaggctgaggtgagaggattgcttgagcccatttattcacaatcagccaaggcaaaatagat

SEQ ID NO: 43120 - DNA, 370 bp, Homo sapiens
atggcaaaagagagagagagagaaacacctagagtccagtgggggtcatcacattgcaggaggaggatgggggcatgaagggggtccttggagaagttctggagagaaaaaagctgagacaaaaaggagatgaagttatggtcaagccagagaagacgttggattagcactgcatgcatgataaaccagccatgctactagtataattctgacattttggaaatattgaaatcctacatgaagaataaatggtgtctgtattttctcagacaatgaatttgttcaaaacaattgaactcatggacatagagagtagaagaatggttaccagaggctgagaaggtagtggggggcatgtggaggacaggtg

SEQ ID NO: 43121 - DNA, 321 bp, Homo sapiens
gtctaaacatatgacataaacagaattaaaaccaaaaattgtatagtcatctcaatagatgcagaaatagctttcgacaaaatccaacatttctccatgataaaaacccttgagaaactaggcattgaaggaatatacctcaaaatgacagagccatctaagacaaacccacagccaacatcatactgaacagaaaaaagctggaagcattttcctggggatctagagcaagaagaagaatgctactctgaccgcttctattcaacatagtactggaagtcttagccagagcaattaggcaagagaaaaaaataaaggcat

SEQ ID NO: 43122 - DNA, 137 bp, Homo sapiens
cttggtggtacacgcctgtagtcctggctgctcgggagggtgaggcatgagaattgcttggacccgggggacagaggttgcggtgagctgagactgcaccattgcactccagcctgggctacagagcgatactcttt

SEQ ID NO: 43123 - DNA, 390 bp, Homo sapiens
  misc_feature 7: n = A,T,C or G
ctttttngaggtaattcctttacctcacctctttgtagggtctatagctttatgttcactttcacccagtactaatcaaatctgttgaaagaaatatgaaagacctatatgaagaaaatgtaaattctcctgaatgacttaaaagatttgaataaatggaaaaaagtgccatattcttaaaaagctcaatattgtttcttaagtgatcttttaagtctgatgcaatcctagtcagaatatcaatgggattttgtttgttgttatttattaataagacagttcataaataactgaagtttattttgaagaataacatggcagaggtgcctggaaaaatctgaaaaaagaatgatgaggctggactcattaaaatttatgaaattattagta

SEQ ID NO: 43124 - DNA, 312 bp, Homo sapiens
gatccggtttctttttgctcgcccctgttttttgtagaatctcttcatgcttgacatacctaccagtattattcccgacgacacatatacatatgagaatataccttatttatttttgtgtaggtgtcagccttcacaaatgtcattgtctactcctagaagaaccaaatacctcaatttctgtttttgagtactgtactatcctgtaaatatatcttaagcaggtttgttttcagcactgatggaaaataccagtgttgggtttttttttagttgccaacagttgtatgtttgctgattatttatgacctg

SEQ ID NO: 43125 - DNA, 110 bp, Homo sapiens
tgcagtgcctacacctgtaatccagcactttgggaggccgaggcgggtggctcacgaggtcaggagatcaagaccatcctggccaacatggtgaaacctgtccttctact

SEQ ID NO: 43126 - DNA, 414 bp, Homo sapiens
  misc_feature 5, 6, 34, 35, 81, 90, 111: n = A,T,C or G
atgcnnaaacacaatattccctggtatgcttcanngcttgatattggaactggaaatggtgttttcctggttgaacttgcnaaatttggnttctctaatattactggaatngattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggctttttttctaataacgtcatgtaattggaccaaggaagagttgctaaatgaattcagtgaaggttggagtac

SEQ ID NO: 43127 - DNA, 150 bp, Homo sapiens
  misc_feature 2: n = A,T,C or G
gnaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagcg

SEQ ID NO: 43128 - DNA, 413 bp, Homo sapiens
cactgacatacttcctcaaataaaaaaacataagaaagagaaactatttcaaaagaaccaagtggaaaatctgcagttgaaaagtgcaaacaccaaaatgaagattcactagaggggctcaacagtagatttgagctggcagaaaaaaagaatcaacaaactggatgtacataaagatagaatatgtaacttgaagaacaagaggaaaaaagttaaaatgaataaggccccagagaaatgtcagacaccatttactgcaccaacatacccataatagaatagcagaatgtgaggcaaaagagaaagggacagaaaaaatattcaaagatataatacctgaaagcttccctaattttatggagaacattaacatacatccaagaaatgcaacaaactccatgtaggaaaaatac

SEQ ID NO: 43129 - DNA, 470 bp, Homo sapiens
gctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagcttta

SEQ ID NO: 43130 - DNA, 351 bp, Homo sapiens
gtctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgttgcctttgccgccaccatgcccaaaacggatctctctctgttgcacaggatagagtgcagtggcaagattttggctcactgcaacctctgcctcctgtgttgaagcaagcgattctcatgcctcagcctcctaaatcagtgtgcgcgtgaccaccatggatgcagagctggagtttgccat

SEQ ID NO: 43131 - DNA, 394 bp, Homo sapiens
acccttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatga

SEQ ID NO: 43132 - DNA, 150 bp, Homo sapiens
gcttcactcaggctgcacattttcacatccatcagagagtccacactggagagaaaccctacaagtgtgatgtgtgtggtgagggcttcagccacaattcaccattaatatgccatcggagagtccacacaggagagaagccatacaagt

SEQ ID NO: 43133 - DNA, 297 bp, Homo sapiens
gggttggtaagtaaaggggtatggctaagtagcccgccaaggaggatgacatgtgcactaagctgatacttggctgatgtgctgtgagaggccagagcaggcagcagtcaaggtcaagcaaagcttcatttgacctgggcgtgaaagaatgtgcaggactgtggtaagcaaaggagacaggtggcatttcaagcttcaggaatagaatgaacagggagttggaggaaagaaaacacaaaatggcctgttacaatagttaaggcaagagatggggaaaccttcaacctggtcaccagc

SEQ ID NO: 43134 - DNA, 472 bp, Homo sapiens
  misc_feature 130: n = A,T,C or G
aaggtagcacgtagctacattaaaaagaatgtacagaagcctagctgtgtctccatagccatgttgctaagactttggctgaattgttcactactagacccctagagcctagcacaaggtttggtgtatnctagatgttctgcaaagtttcattaatttgttgagtgagaaaataataaacactgccgtgttcacatcattatgttgacccaacagacaatctcagggacccttgggctggtgtagtcaatcacaagggctatttgtagagacagctccccgctgtgaagccaaggagaatccaaccatgaagagagaggaaatattactaagcagaaaattaaaaacgatcctattggctgttggccttggcactgtttctgaagaagcaagttcagaaacatttggcagtccgtgtcatcgcctctcataaaccccaagaataaggaaggcatcagaaataaatttttat

SEQ ID NO: 43135 - DNA, 472 bp, Homo sapiens
  misc_feature 224: n = A,T,C or G
gagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagnaagaagtctatgcagacaagagaaaagtgatgactggctatttggaaaacctgggtgctactgccaactgggtgtatcataagctctaagatcaagattttgtaggagtggacagtcattacatatgttataacttatcctttaaaaactattttaaactttatcctttcggctttacttagtgcgatgttttagaaagcagtcttcaaagaataaaacactaaccatgcatgtgacatatttggtga

SEQ ID NO: 43136 - DNA, 393 bp, Homo sapiens
  misc_feature 377, 383, 389: n = A,T,C or G
atgaatagatatgtgtaagataaaggatttgaaagttaaaatacatgaagcaaagctaggatttttttttcttttttgagacagagtcttgctctgtcacccaggctggagtgcagtggtgtgatttcagctcactgcaaccttcgcctcccagcttcaagcgattctcatgcctcagcctcccaggtagctgggatttcaggtgtgcaaccaccacacccagttaatttttgtattttttggtagagataggggtttcacatgttggccaggctggtcttgaactcttgacctcaagtgatccacctgtctcagccttcccaagtgctgggattacaggtgtgagccatcacactcggccaaagctaggatttaantaaaantttggnctga

SEQ ID NO: 43137 - DNA, 266 bp, Homo sapiens
  misc_feature 6, 249, 252: n = A,T,C or G
agaaanactactggaaagcctggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgaggatgaagatatacaacagaaaatagtggctgtgtttggaagcttcagccctngcnacaatttgaaactt

SEQ ID NO: 43138 - DNA, 267 bp, Homo sapiens
  misc_feature 19, 24, 29, 31, 32, 35, 41, 42, 46, 49, 56, 58, 59, 60, 63,64, 66, 69, 80, 82, 87, 89, 90, 95, 100, 110, 115, 251,254: n = A,T,C or G
atgactgggcactagatangcatnacatncnnatnctaaanntgcnccncgggaanannnatnnanaantgaggtgcacngnaggcncnnattgnacacnggatgagttncaaangcttttgctccaagcccttacgtacagtagtcccctcttatttgcagttttgttttccgaggtttctgttaccttctgtacagtataagaagatatttttgagagacagaaaaaaaacacattcatataactttgntancccgggattattg

SEQ ID NO: 43139 - DNA, 354 bp, Homo sapiens
  misc_feature 12, 14, 25, 36: n = A,T,C or G
acctcggccctntntggccgagagngcctgccggangatgaaatggcctgaggctgagtggccgagagattgacgttcgaattgatagaaacgcttaagcagttgccttttttaaacactcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaatttttttgtagttgtggcatcttgttgacatcgaatatgactttgataataaataccggttcctg

SEQ ID NO: 43140 - DNA, 258 bp, Homo sapiens
  misc_feature 10, 11, 36, 37, 45, 51, 56, 58, 70, 84, 97, 112, 135, 177,225, 232: n = A,T,C or G
ctaccctccnntggggactaagcctaaccctgaganntcttactnactgangagancncttactctgcantactgcccaaaaanttttaaagcaaantgaaaagctacccantttaaagttaccggaatctaccncttttaaagttaattgcttgtcaagctactaacccacaaaantaatgaattgatgagaaatacaatgaaagaggcaatgtccattctcanaaatacntgcttttacaaaagcagaataaaagt

SEQ ID NO: 43141 - DNA, 345 bp, Homo sapiens
  misc_feature 265, 280, 296, 328, 331: n = A,T,C or G
agaaggagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttganggggggtgtctaaantttccccttttaaggnttcaacaaaatttcattggcccttttcctttnaanaaagtggtggcttt

SEQ ID NO: 43142 - DNA, 498 bp, Homo sapiens
  misc_feature 7, 8, 42, 101, 407: n = A,T,C or G
aaaacgnncccctctacgtactccctgtggagaaaagctaanaacctttaagaactgtgggtggtattggagaaagaagatgaattactagctccggagantcaagactcttaagtgaagcctttctgttcagatgtgatctataaaaaatcctaatttggggaaagtttaagcaaatctggctttgtagtcctgatgttataagtgactttgtgatcaaactgtcaggcttgggttcttgttatagaatgcttggtattagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactatggggnttttttggcctcataaagatggtccacttctgtacacaggcattcctcctgcaataatgttgtatcttttgagaaccgttggcaaggtgta

SEQ ID NO: 43143 - DNA, 455 bp, Homo sapiens
  misc_feature 68, 346: n = A,T,C or G
cacttgagggtaacaagcgaataacatgtagaaatggacaatggtcagaaccaccaaaatgcttacantccgtgtgtaatatcccgagaaattatggaaaattataacatagcattaaggtggacggccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattngttttactcctttttattcatacgtaaaattttggattaatttgtgaaaaatgtaattattaagcctgagaccggtggctctcttcttaaaagcaccatattaaatcct

SEQ ID NO: 43144 - DNA, 500 bp, Homo sapiens
  misc_feature 2, 6, 60, 105: n = A,T,C or G
tntttngccggggtgtcctggcgctttgccagcgtgttggagagtccgctaccggtgaanccagcgcgggtttttcggacttgggggtcgtgcagatctgctggntctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgataagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacattggtgttatcagtacaaaggcatggggggctgtccatgggcaccat

SEQ ID NO: 43145 - DNA, 367 bp, Homo sapiens
  misc_feature 2, 58: n = A,T,C or G
antgatttcctgaagagacaaaagacgggaagattcgcaactgcagaagaaatagccntgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctcttttgtagtctcttctgaaatcattgtaaagaaataaaaatattgaactcga

SEQ ID NO: 43146 - DNA, 453 bp, Homo sapiens
gactgctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgactatcgctggggtggtccataaggatggcatagttcttggagcagatacaagagcaactgaagggatggttgttgctgacaagaactgttcaaaaatacacttcatatctcctaatatttattgtttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagtttaggggga

SEQ ID NO: 43147 - DNA, 210 bp, Homo sapiens
  misc_feature 9, 86, 95, 104, 146: n = A,T,C or G
agcctggcnaacatggcgaaaacaccgtctctacaaaaaaatacaaaaattagccgagggtggcgcacacctgtaatctcagctanttcaggaangctgagacntgggaaatcgcttgaacctgagggggtaagaaggttgcactngagcccgagattgcatcacttgtacctccagcctggtgacagagcgagacgctgtctcagaggg

SEQ ID NO: 43148 - DNA, 434 bp, Homo sapiens
  misc_feature 3, 5, 9, 10, 12, 21, 65, 301: n = A,T,C or G
ctngnaaanncngtaaaactncttgtactgttcttagtactttgattccttacttgaggtcctantttgctctgctaggcacttcttagatgtttttgtgttagttggttgtctggcagccagggaagggggatgtactaaagcaacatagctttctcactttgtgatttacctcccagctttgtttactggcaacacagccaaggagaaggtgaaccaatgacattcttaaagttgacctatttaaggagttattcattaagggttctacttcttacacataagactcttaatatatttnatattaaaatttttgcagatccttccgctgaggaattgagaaaactaatgatgttgcatgggaggtcaataccatgtatattattccagatctaaaacaacacatattattgccacaaatcttcccaatgcca

SEQ ID NO: 43149 - DNA, 471 bp, Homo sapiens
  misc_feature 411, 471: n = A,T,C or G
agggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatntatttaaatttttctcaagctattttttgttactattttcctaaaattgaatatttgcan

SEQ ID NO: 43150 - DNA, 392 bp, Homo sapiens
  misc_feature 15, 18: n = A,T,C or G
actgggtctaatttntcngactgatagatctggttaagttgtgtggtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatggatttttttaccatttcgacttacataatgaaaaccaattcattttaaatatcagatattaattt

SEQ ID NO: 43151 - DNA, 471 bp, Homo sapiens
  misc_feature 6, 11, 377: n = A,T,C or G
tatctnatgcnctaaaaattgcttcttgcctcttctgccaatcagaataccacatcccaatctgaagcacttgccctgatctctttcccttccttattctggaggaagggaatgatgggacataaagggccagagaaagaagaggggtctcctgactcactgtactttcctcctggccacagctgggttgcatcacactattcttatgtctcataagccttgagtttgggggtaggaattgggactctgaaggacatctcaagtgttcttcatgtttttgggtcactttcccctttagccttttgactgaaaactatggactgtctctccagaaaagtacatgagattttacatctgatatagaatagtttaataanacaagtccccttactgaagtccatccatgaaccttaggataagaatccttggaagctacttcgttgaactgttccatctgcttctattagcatg

SEQ ID NO: 43152 - DNA, 495 bp, Homo sapiens
  misc_feature 13, 444, 467, 488: n = A,T,C or G
ctggccggggagngcggaggtggtggcggcggaggctttggcagctcgggactgagtgcaagaatcagcatgattcttcagaggctcttcaggttctcctctgtcattcggtcagccgtctcagtccattttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaaaatttgtcacggatttaaanttgtacaactagtttaaaaaaantttcaaaaaataaaccatgcnttttcct

SEQ ID NO: 43153 - DNA, 473 bp, Homo sapiens
  misc_feature 33: n = A,T,C or G
gttgccagaaaggctggatggttttaagaagangggtctttctcttccctcttatgcttcaattttattttgtaccccacagcttctcttgaacagcctcttctgatgtttctaggtagtaggaaccttacaaatacatttatatatatgttgctgttggaatctatctaaatgccactcatttggtcctgcgcataatgtaagatgtaaacattccaagtcttctattattatactttagtattggaaatggattacgtgtggactattgagattaagatgactcctttctcttagtgggctactatttaagactttgttttttatattgctgattatatatattctaaaggaagattttctcaagaaagcagtttttgcaccatttagaggacctttaaaatttgtataattttcacagttaaagctttcttaaaccctagcatgtagtcttattatgcctttaaaaatga

SEQ ID NO: 43154 - DNA, 438 bp, Homo sapiens
  misc_feature 2, 4, 34, 47, 92, 366, 415: n = A,T,C or G
cncnggcccggggtctttttgttgttgttgaaanttagggtgtatanttaaaggtagtttttacccagatcttatatgtgtaatagctcacntctgtaatcagaaacttactgtttaatggccacccaattgccattagcttcctagagggtgatttaataaactatcttctttaaaactcatttaaaattagagacatgtttgcatacaatggattaatgacgttttcatactaacccacaaaagtctgctgcactttcttttgtaggcctaacattcatttcatatgcattgattattatttgttgaacttgcattaattacatcgtgcatatatggacatacaatgtcatctgcagaatttangattttttattggtaatttttaaaaggggcctgggggttgggggaattnaaaattagcctgcttcatttata

SEQ ID NO: 43155 - DNA, 467 bp, Homo sapiens
tatcaaaaaaattaagatctataaattgcctggcaaattgccttcaaaagaattgttttaagggaacaattcattaagtgaattgaatgtgctacaagaaaacacagaaaagcaactaaatgatatcagaaaaaaatacacgagcaaaataaaaagttcaataaagatttagaaattatgagcgaaaccaacagaaattctggagctgaagaatgcatgaataaaatgaaaattgcaatagagtgtcatcagctgccttcatcaaacagaaatgatctgtgaacttgaagatatatcatttgaaaatattccatcagagataaaaaagaaaaaaacagtgaaaacaaatgaacaaaacctacaacatttatggaacaatatcaagaaagcaaacggtcactgtatgggagctccagaagaagagacagaaaaggaacagaattcttatttaaagaaataattggctg

SEQ ID NO: 43156 - DNA, 119 bp, Homo sapiens
gtattcctggttacttgggaggctgaggtgagaggattgcctgagaccaggaggttgaggttgccgtgagccaagattataccactgcactggactggatgatagagcaagaccctgtc

SEQ ID NO: 43157 - DNA, 398 bp, Homo sapiens
  misc_feature 391: n = A,T,C or G
tgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacaggggttctttgtgtaaggttgttcaacagtgttgtgccagcctacaggaggaaaggccagactcacagaagggtgttcatttagaagaaagcaacactaatgattcaaacagcttcctgaattttgtgttgtctcacagaaagccttatcataaattccataattctaattaatttaccaagataatgnattcatt

SEQ ID NO: 43158 - DNA, 348 bp, Homo sapiens
gtattagtctgttctcacactgctcataaagatatacccaaggctgggtaatttaaaaaggaaagctggccgggtgtggtggctcacgcctgtggtcccaacactttgggaggccgaggcaggtggatcatgaggtcaggagttcgagaccagcctgaccaacatggtgaaacccccatctctactaaaaatacaaaaattagccaggcgtggtggtgggcacctgcggtcccggctacttgggaggctgaggcaggagaatcgcttgaacccaggaggcagaggttgcagtgagccaagatcataccattgcactccagcctgggtgacagagcaagtctccatcac

SEQ ID NO: 43159 - DNA, 473 bp, Homo sapiens
  misc_feature 17: n = A,T,C or G
atctggcatttttttcnttgtcaggcgccaccctcatgctgaactttcatcaggaaggcacgttttgggggccacctcattagagagtttattttgtgagattctgcaagctgctgctcgctgctaacccacatgtgcttttccgggaccaatccacccaggattaatcatgcggccaacaaatttccctgtgatttccccgaaacgcttgtcagtttggaggccctgaaatcctcatgagttgttaagaggtttttgttgcactgaaggcacttaataaagatcaggtctgttagaggctttgtgagggaggcctctgcattgcactggtgtataagatccaaaatagcattgaatatagaaaagcacaatttaaaaaatgtgtccgggcatgagaaggctaagtctggacgtggccaaagggactaaactccttcctttctttggcttctgtaaaatgagcagcacgcgag

SEQ ID NO: 43160 - DNA, 330 bp, Homo sapiens
actgtactctattaatagcattatgtctgtaaaaacaatgtacatatctggccacacgtggtggctcatgcctgtaatcacagcactttgggaggccaagatgcgtggatcacttgaggtcaggagttcgagaccagtctggccagtacaatgaacccctgtctctactaaaaatacaaaatttagccagatgtggtggccgatgcctgtggtctcatctactcaggaggctgaggcaggagaatcgcttgagcctgggaggcagaggttgcggtgagcctagatagtaccactgcactccagcctgggggacagatagcaaaactctgt

SEQ ID NO: 43161 - DNA, 472 bp, Homo sapiens
  misc_feature 210: n = A,T,C or G
ataggacctcctccttctcgtggcacttccttcaaatggaaattttaaaaatgtaacacagcaaaacctcataagtacgcccatctatgataatctgtccaacctgagagattaataaatgaaaaacttgtttattaatcaactagcaaaaacaagcatggttatttaagaaaatctgttagcatttacaaatactcatttacatatcangactgactgcttaccaaattaattaatgtgaagtttcactgtgtatagaacaaaccgacagacacataagaacactttagattattgcaagatgtttccagaagcccacatactagaaatgtggaaaccaagtttttcagggaaagagaaaatacttaccaccgttagcacttccttctcttttgccacgggagcccccactgccatctctgcctgactttatgcgctagagcaaagagaagacaagtttaaaaggataagt

SEQ ID NO: 43162 - DNA, 261 bp, Homo sapiens
cacggtggttatgcctgtagtctcagcactttgggagggatcatgaagtcaggagttcgagaccagcctggccaacatggtgaaaacctgtctctactaaaaatacaaaaaaactagctgggcatggtggcacgcacctgtagtcccagctactcaagacgctgaggcaggagaatcacttgaacccaggaggtggaggttgcagtgagccgagattgtaccattgcactccagcctgggcaatagagggagactccgtct

SEQ ID NO: 43163 - DNA, 230 bp, Homo sapiens
caggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggttt

SEQ ID NO: 43164 - DNA, 338 bp, Homo sapiens
gagacttgtgctgtgagagtcatccttgctgtgtgtgcgcgaagctgttcatttccttgctgtatagtggagcagaggcgatctcagctttccggtgtctactcaagagaattcaaacaggcgctcagacagatacctgcgcacccgcgttcacagcagcattacccacaacagccagaggctggacactaccaagggtctgttatggttgaagagataaacacagtgtgtatacagtggggtgttattcagccacggaaaggaaagaagctctgagtcacaccgcaacatgccctggaaactgtgatccaatcataaaatatgataacatattgtga

SEQ ID NO: 43165 - DNA, 269 bp, Homo sapiens
  misc_feature 3: n = A,T,C or G
agnacaacttctttaaggataatataataccaaaaattactacttttattttgttatattattgcaacaaaaattattttaattttgtattatgcactaaaatgcatgaaagcaaacaattttaactgtctataattttgtaatctaaaatgtaaataaaataccgcagatattaaaaacattatgggaatagcaggaagaacttgatactagtaagtgtgaaaaataaaacattgaaattcctaggaaaatgtgtcttatcaaaattg

SEQ ID NO: 43166 - DNA, 163 bp, Homo sapiens
  misc_feature 53, 85, 108, 111, 133: n = A,T,C or G
aagaagactaatgaataagcttctaaaaaaaaaaatgctttgtcataaaaccnttgtagaccctaacttttaaaatattctccgngataacctctgttttcatttaanaanattgatctgacagtctcctgtnttggtcagtctacttttggaagcaagcaac

SEQ ID NO: 43167 - DNA, 232 bp, Homo sapiens
  misc_feature 21: n = A,T,C or G
aagatttttttgtttgtttcnagagaacattattaatttagattatattaaagacttacatggcaggagactttcttctagataactaaaaacactgcgtagaaagttatactatgtttggccgggagcggtggctcatgcctgcaatcccaacactttgggaggccaaggcaggcagatcacaaggtcaggagttcgagagcagcctgatcaacatggtgaaaccccatct

SEQ ID NO: 43168 - DNA, 472 bp, Homo sapiens
atagatgaaacattttgagataattagaattgttattattatgatggccaaaaccacaactccttttgtaccaacctaatatatacataaaatatgcattctggtcactactcaccaaatattgttaaaaaatgaaatttctcttttcaaaatacctgcataatttcctccaacaagcacaaaaataccattgagttgaatggtagctattttacctatagaaggggctcattgcccctcttaagaacttcaccaagttcactgggttgtaataacacttgcttatctctttgagttgctttcagatctaggagctaatagtagggaggagtacctggtgtccgtctgttaaaagtaaaaaaacattaggtgatagtccacagggcaaaccagctacctgagcataggcagaaaattgcctcccagttggtattcataatattaatacttccataagcataaagcatacctc

SEQ ID NO: 43169 - DNA, 251 bp, Homo sapiens
tgaggaaacagtaccgaagttctttttcttatggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccg

SEQ ID NO: 43170 - DNA, 182 bp, Homo sapiens
agtgagaggagaaaaaagacaaataatatcaaaatactggaaagttagaatgatagcccctaggaactaggggttgggagtagggttgagggagaaggcaaagatgattccacaagggataataaatggtgttggtaaaatcaggcaaaaaataaaataaattccacatggatcaaaacttt

SEQ ID NO: 43171 - DNA, 305 bp, Homo sapiens
gtgtataaaaggaatcaaattttgagtaaacatgatgtattacatcatcttcgaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttag

SEQ ID NO: 43172 - DNA, 408 bp, Homo sapiens
caagtggaaacattaactagtctagctagccttctggtgttttccttggttaattcacaaagagcatcgcacagtggatttttacgtagtagtaacaatttgctgtaaaattgtatggtctgaggatatgaccgtagagtttgtcttctgtgtctccaaacttactatcctgtacatcttgactcattttattcatttttcacttcattaaacaataaggatttaccttaaattaagcatttttttggtatgttttattgtctcctagtggtcctttgtaatgccatatggttgctgcccagctcgacttacaaacttactctttttgcttctcatactagccattttgcaagcctgagctgctttgtggtacaggtcaagtacttatggagtaaagttaaggggaat

SEQ ID NO: 43173 - DNA, 285 bp, Homo sapiens
cggaggtagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtg

SEQ ID NO: 43174 - DNA, 277 bp, Homo sapiens
  misc_feature 7, 56, 277: n = A,T,C or G
cccttcnaagttccgcgaattccttagtctgacaacttttctcaattcagaaagangtgtttggtaacatatattaaaaggcagaaatatgcaaatgcataaacaatagaatttgacataattatgtgataaagtgaaatgctcctgcagttagttattgaacatgaaggacctctctaattcttcagagaaactgtgagataatctctaccatttatgcttagcaaggagccatgctgcagaggaaaagtagaaatacgcacgagtgacaaaagcn

SEQ ID NO: 43175 - DNA, 287 bp, Homo sapiens
aacgtgtgaggaattatatggtctatttgtagaactatacatagaacacttgatcgtgcttctcagaataagacaaaggcctctaggaagaggtatttgcttcctcattttctagatcttaatttaagcaagccaaggagtcagtgagatgtccccacaggatccgatggttagtgggaacaccgtttaacaccaaatcatcaaattgtagaagtttgatgctagaaaggatcttgaaagaccatgttctctaccatttttaacatgacagagtgtatacattagat

SEQ ID NO: 43176 - DNA, 272 bp, Homo sapiens
  misc_feature 272: n = A,T,C or G
agtaaggtttgggcccacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtgn

SEQ ID NO: 43177 - DNA, 472 bp, Homo sapiens
gttccctacaaaaactgaaacctcgctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgttttgagttcttcactgtt

SEQ ID NO: 43178 - DNA, 310 bp, Homo sapiens
cataaaggaatggtagaacagtccttcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaaga

SEQ ID NO: 43179 - DNA, 133 bp, Homo sapiens
  misc_feature 133: n = A,T,C or G
caagcaacttttaaaatgttttggtatttatgtctttcatatttaccatctaaaatcacaaacacaggattttagatggcattttaaaaattataaaattaattttatacatggaaataaaaactcagaagtn

SEQ ID NO: 43180 - DNA, 361 bp, Homo sapiens
  misc_feature 28, 360: n = A,T,C or G
tatctaaataaataaataaaaataactnaggaaaatatcccctttaagtattcttgagaaggactacagtaaacataaaatggcatttgcctgaaaaaaataggaaacattttaaaagaaaaaaatgacacttgcttatcacttttaaaacaataactataaagttttaagaaatgaactgtcttccagtacaacaaagcttagaaatatctacatgtaataaacatacacagagctgtgtttctccacttccacagatataacagaaaaaacatgaaattaaatttacagcattcctagaaagccaagaatcataaggcgcttctggatgatacagaacagatgagaaaagactgaccnc

SEQ ID NO: 43181 - DNA, 394 bp, Homo sapiens
gagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagc

SEQ ID NO: 43182 - DNA, 253 bp, Homo sapiens
attctttaccgttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatat

SEQ ID NO: 43183 - DNA, 447 bp, Homo sapiens
aatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtgggatttgggcccctcatcttcatttattatattatcaaaactgagagggatagggaaagaaaaacttatccaggaaggaaaattggatcgaacatttcacctctcatattaagtctggcaatgatgactat

SEQ ID NO: 43184 - DNA, 315 bp, Homo sapiens
atctttaggttgagcaggtcctacaagtgatcaggacagtgaatgaaaaagatccatacctaggcatacccctgtgaaattttagaacacgggggtagtgggggtgggtgtaggtcacagaattatgaatcagaatggcctaagactggtcagtaacaacgggggaagttgaagacattggagaaacatcctcagggtgctgagtgaaaatgtgtctgccggagggggaaaaagacattttcagatatacagggtctcaactgatttatctcccacgggcctttttctcaggaaactccaccaaaacatgtccat

SEQ ID NO: 43185 - DNA, 406 bp, Homo sapiens
atgaggactgcgtctttttcactgaccctatgatttcactgtgagtagggtgaactggactgcatattagtttatttgttgccataatcacatttttgaaaaataaatttaagagttttttcttaagtaagcttgtttttgcattgcatgctatattctcagttactttcttttaaatggttataccctttccttctatttattcataatttcttctctttattcatagttacactgactgtcactctggtcatttcttgtgtctaaaaccctactaattatagccatatgttttgtacaaagttcaaattatagctgctgctaaactaaccgttaagtgtacttatgttagcaaacccagtttgtggagaggcattagtttccttgccataattacgtgatgtga

SEQ ID NO: 43186 - DNA, 445 bp, Homo sapiens
agtctccctgagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggattagaagacttagaatagaaacttttagtattaccgatggggaaaaaaaaactactgttaacactgctaatgaaagaaaatgccctttaactttctaatgattatagat

SEQ ID NO: 43187 - DNA, 118 bp, Homo sapiens
atcctgacgtatggtaattctccctctgtccttttaagaattattttaccagttatgtgtataacaatatggtttacattttgctcacttttgacttatataaaaatagaataatact

SEQ ID NO: 43188 - DNA, 195 bp, Homo sapiens
  misc_feature 19, 28: n = A,T,C or G
tctttctcttaacctgttntttactcantttttcccagtatttttctacggaaaaaattgtatttgaaaacacttagtatgcagttgatgagaggaatttggtataattatggtgggtgattattttttatactgtatgtgccaaagctttactactgtggaaagacaactgttttaataaaagatttacattgc

SEQ ID NO: 43189 - DNA, 315 bp, Homo sapiens
catgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttt

SEQ ID NO: 43190 - DNA, 430 bp, Homo sapiens
  misc_feature 68: n = A,T,C or G
gtacctggagggatgcaagacttcaattaccttagcagcaactgttttgagatcaccgtggagcttanctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactgggagattgcttatacctggaaactataaacttacagcctcagctccaggctatctggcaataacaaagaaagtggcagttccttacagccctgctgctggggttgattttgaacctggagtcattttctgaaaggaaagaagagggagaaaggaagaattg

SEQ ID NO: 43191 - DNA, 381 bp, Homo sapiens
  misc_feature 3: n = A,T,C or G
atnataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtggcttatgtttgaagtggtttttttg

SEQ ID NO: 43192 - DNA, 382 bp, Homo sapiens
  misc_feature 2: n = A,T,C or G
cnaactgtgggtctaaggaagatgtaggataccttaagcttgttttcctatttgaattgaattcctacttgtagaagtatgaattccctttgaaaaggctgattggtttgaagaaattaacctggttttaattatagctctaagaatttagtcattagtcaaattaaacccaagctgatattctcggaacatatatgtatgtattaagtgttctagaatagctacatattacttttataatcacaggaaaagccatctaaaaaagaatgtatttttttaaaagatagtttatagcagcaggaagtagattggtagttgcctggggctgcttctcaagtggttattgactgcagatgggcaggagggagttttttggggggtg

SEQ ID NO: 43193 - DNA, 278 bp, Homo sapiens
cagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacctaaaatctgcttatggcacaatttgcctcaaaatccattccaagttgtatatttgttttccaataaaaaaattacaattcg

SEQ ID NO: 43194 - DNA, 500 bp, Homo sapiens
  misc_feature 2, 19: n = A,T,C or G
cncccagggaaattcggcnttttggccgggcagcaaaaactgcttttgtctacaacagtagccctttactaaactctttgagtgagtgaaaaggtagtgtgctgatggtaagacaaaggacaaaatgccacactgaacaagagaatgggattcaaggaatttttcttcaggttcataaattaagcatctcataaggtctttaaatatgtatagaatggaataacttggctgggcgtggtggttcatgcctgtaatcccaacactttgagaggctgaggccgggagattgcttaagcccagggattcgagacaagcctggcaacatagggagaccccgtctctgaaagagtaaaaaataagttagccggacatcgtagcgcatgcctgtggtcccagctacttgggaggtaggatgggggaggatcacttaggcctgggacgtttgaaggttgccagtgagccatgatcatgccacggcactggcaacctgggcgacagag

SEQ ID NO: 43195 - DNA, 426 bp, Homo sapiens
  misc_feature 3, 6, 11, 375: n = A,T,C or G
acnctnaactntctaacaatctgcataagtctgattctctttctctgactttgaatttagaatcacttaaagcttttctaaagaatcgataaattcacctgtatttgttgttagaaaaaaactgggtgtctgtacattttgtggtgtaaaatatgtaattgaagattactattttaagaagtcatcagtcatatcactcacacagaattttattttacatagttttgtgacttaattacacatgaatataaaatctataattctatatgaatatatagagatatagaaacatctgaactggtaaagaataactataaaatatgaaagctctaaatttaaaataaatttagagatagaatcatggtacattattgntttcagtattccatgtaaaaattttatagcttaaatgtagtcaggggtttg

SEQ ID NO: 43196 - DNA, 473 bp, Homo sapiens
  misc_feature 4, 463: n = A,T,C or G
aatnaggcttatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagaagaggtggcagcattcagcagtatatttataaacaggaacctgtaccagaagtgcccctggnaagaaggcct

SEQ ID NO: 43197 - DNA, 394 bp, Homo sapiens
  misc_feature 39, 345: n = A,T,C or G
agccagggaacgggcttggcggaatcagcggggaaagangaccctgttgagcttgactctagtctggcacggtgaagagacctgagagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgnttgggagacccattttacaaaattacatctgaagcacttcttgttacac

SEQ ID NO: 43198 - DNA, 327 bp, Homo sapiens
  misc_feature 216: n = A,T,C or G
atcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatatgcaagctgatgaagattgtagacatgtgctggggagaangactggccaaggggagaagatgcctttcgggcagtgctttgctgcatgcagctgaaagggaagctccaacctgtatccaccattcttgccaagtcactcacaggagagtcc

SEQ ID NO: 43199 - DNA, 418 bp, Homo sapiens
  misc_feature 19, 333: n = A,T,C or G
gtccctagcaggaaaaganttcaagaggttcaaagaatatgtcacttactcctacttgctataggaataaccttactgataagaaaaaaagggacaactattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccangggttgcctctccttatctacggggattactttgtacatgcagattaaagttttcgcaaacctatttccattttcttttgtaagc

SEQ ID NO: 43200 - DNA, 412 bp, Homo sapiens
  misc_feature 14, 15, 312: n = A,T,C or G
gatctgggggagannagaggctaagggaggaaggggtgaaggattaaggagttggagagaattggaactggccagacagggctatttgagcttcacactacctttgggtattggttgctgaattaatcctgcagtgtaagtcacacttagacatgcctaggtgtgactcttggggttcatttactttactacagggtttaatctctgcgcattttgagtgaggaaaacatgcttgccatgggaaggaagaaagcaggtgctctgtctcccttccccacctcttcattgtcctcagttgcaatgccatttgantaaggtaagttcttgaaatacattgtacgctttattcccaggctgcagggattatttgctgacatagaccatgggtcctgcagccagccccctgtgtatg

SEQ ID NO: 43201 - DNA, 429 bp, Homo sapiens
  misc_feature 20, 22: n = A,T,C or G
gggcctcctcttagtccgcntntaattctcagaccgtaaatctggcttcacagaaccgtaggaactgtgagtaaagatggaatagaggtaggacctttgtttgtcacaatattctaatttagtctttattgaattatcattgtaattaatctttattttatgtccagagggttcttacatagaattcaagagcctaggctaggaacagagagagaatagagacctcagaatccaatctcttgtgagttctcaaaaataattaaaaacatatatctacggatggtaagatgtggggaataattatgcaacaggaattatttcttcaagagggagggaatgtgccttttctgctagtcaggaaaagtccaacacaggagaagatgagcaactttggttggattttgaaggccagaagggcagagctagatt

SEQ ID NO: 43202 - DNA, 387 bp, Homo sapiens
cttctaagggttttataattttattatttatatttaagttgctgacccattttgagctaatttttgcatatgctgtgaggtggaggtacaaattcattcttttgcatctggatatacaattgtttcaataccgtttgttaaagagactattgtttcttcattgagtggtcttggaagcctgtcaacaatctattgaccacagacataagggtttatttttgaaatctgatttacactctattgatctatatgtccttataccagtaccacactgtcttgattactatcactttgtaacaaatatcaaaatttggaagactaagtactccaacttaattcttctttttcaagattgttttctctatactgggacccttttaattttct

SEQ ID NO: 43203 - DNA, 294 bp, Homo sapiens
  misc_feature 37: n = A,T,C or G
aatgtccaagtgtaactttaatgttatattttgtttnaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctat

SEQ ID NO: 43204 - DNA, 472 bp, Homo sapiens
  misc_feature 31: n = A,T,C or G
attgcatcgagcttttagtgtcttcttattnacaccgaaaataagcttctgctacagcaaagatcagatgctaagattacctttccaggttagtacacttttaatgtacaatattgtgtttgtacattaatttgactttttatcattctgaattcttggagccaaggtcacaaagggaaatcctgtgaatggcataattttatattctgcataaagtgagtttacacaatgagtgcaacctaatacaacagcaagaaaaaataagaactagtaagcaattgggcaataggtataatttacatatttatctctaatctgtattatctacactttgatcttttttggttaaagaagtattaataaggaacctacctacaaatgtagtctgtttcacaacataattactgatagcccattataaccaattttaaaatccttaaaataattactgatagcccattataaccaattt

SEQ ID NO: 43205 - DNA, 452 bp, Homo sapiens
gattttaaaatatattattttaataccagatgaaattagtgaggaaatagaattcatgacacagaaatttcctttgaagtcaaacttgttaaaaatgtatcatgtattaaataaaaagatgtgggttctctctttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacgggagtttcaccatgttggccaggctggtctagaactgctaacctcaggtgatccgactacctcagcctcccaaagtgcacggattacaggcatgagccaccgtgtccagcct

SEQ ID NO: 43206 - DNA, 425 bp, Homo sapiens
  misc_feature 2, 23, 149: n = A,T,C or G
cncgtcatccgcatcaacaagangttgtcctgtgctggggctgacaggctccaaacaggcatgcgaggtgcctttggaaagccccagggcactgtggccagggttcacattggccaagttatcatgtccatccgcaccaagctgcagancaaggagcatgtgattgaggccctgcgcagggccaagttcaagtttcctggccgccagaagatccacatctcaaagaagtggggcttcaccaagttcaatgctgatgaattttgaagacattggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtcctt

SEQ ID NO: 43207 - DNA, 448 bp, Homo sapiens
gttttaacttattcctaaaatgacagttgtgtcctagcccatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaatttttgattttgatgtcatctgtttgcccttcatcttgcttgcaagtgtgcatggttcaatccctcacatccaggaaatgaattttgcaattgggccagatgctaatttgcacgttgattcaccttctttgcctttaagcctttttttctttttttt

SEQ ID NO: 43208 - DNA, 290 bp, Homo sapiens
  misc_feature 11: n = A,T,C or G
aagctgaaatngagaaagaagtacgtgttttccccaaattcagacattgaaatatagagacaaagccttggacccaccatacactgggggatatgaataaaaaactcctttgttagatctggatccttgaagtttaatcaagtggtttcttatttgtagcacagatccttcctaaaagaaagtttcataagcttaggctgtcaagatttccacaggttgataaaaggcaaatatgagctcatgatcagaaattagcaaacacttaaggaaatctcacataagagttagga

SEQ ID NO: 43209 - DNA, 424 bp, Homo sapiens
  misc_feature 416, 420: n = A,T,C or G
gtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaactaagtttgagtcttgccaggtcaatacttgggtcctgagtatggngacnggat

SEQ ID NO: 43210 - DNA, 397 bp, Homo sapiens
gattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattttttgaaggcttcccagataagcagcccaggaagaaatgaaaactcctctatgtggggtgg

SEQ ID NO: 43211 - DNA, 471 bp, Homo sapiens
  misc_feature 24: n = A,T,C or G
aactcacagttaaatatttggatnagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattacctggatgcacgtacagaatacattcagccgtcaggaaaactg

SEQ ID NO: 43212 - DNA, 387 bp, Homo sapiens
aggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggacccccttcagtgcgttgctcaagcatgtcataaagcttcaccaatcaagtcccatgaaaagacttaatgtaacaactcttttgtcatagcattgtgtgtggtccctatggactgtttactatccaaaagttcaagagagaaaacagcacttgaggtctcatcaattaaagcaccttgt

SEQ ID NO: 43213 - DNA, 169 bp, Homo sapiens
  misc_feature 167, 168: n = A,T,C or G
atagtaaagctgtattgaaccaaaagcctgccagaaaagaattctatattgagatggaaatcaggacttttgaaagacaaggtcttgtgataaaaagttgagcttcgactctgtgtgtgtgtgtgtgtgtgtgtgtgtgtgtgtgtgtgtgtgtgtgtgtgtgtgtnnc

SEQ ID NO: 43214 - DNA, 255 bp, Homo sapiens
  misc_feature 7: n = A,T,C or G
atttacnagtgtcctaggagcaatgaaacctcactgctgagcagacagagaaacagtagccttgcaatagcccttatccactacccctttaggcaattaggtctgcaaaaggatatccatgtcttaagatatattctccaccatcctttctagtattcctggaccccccagacatgggaggttgtgtggtggtagttttggttgattggtcttggcacaactagaggagacactggtgatttagagtattatctt

SEQ ID NO: 43215 - DNA, 426 bp, Homo sapiens
  misc_feature 14: n = A,T,C or G
atacccattgactnccttatccaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagattt

SEQ ID NO: 43216 - DNA, 201 bp, Homo sapiens
agtaaaaagaactggttaatgataacaatgcatcgtaaaaccttcagaaggaaaggagaaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 43217 - DNA, 413 bp, Homo sapiens
  misc_feature 29, 412: n = A,T,C or G
aactttagcaagtctcaggatacaaaatnaatgtgtaaaaatacatgcattcctaatacaccaataatagacaaacagagagccaaatcatgagtgaacttccattcataattgcttcaaagagaataaactatctaggaatacaacttacaagggttgtaaaagacctcttcagggagaactacaaaacactgctcgaggaaacaagagaagacacaaatggaaaaacattccatgcttatggatagaaaaaaatcaatattgtgaaaatggccatacttcccaaagtaatttatagattcaatgctattcccatcaagctaccattgactttcttcacagaattagaaacaattactttaaatttcctatagaaccaaaaaagagcctgtatagccaagacaatcctaanc

SEQ ID NO: 43218 - DNA, 438 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgcccgcagttggatttgggatg

SEQ ID NO: 43219 - DNA, 133 bp, Homo sapiens
atttgtaaaaagaaaaaaaaccgacttttcgacaaaccctttgtattgtagataagaggaaaagactgagcatgctcacttttttatattaatttttacagtatttgtaagaataaagcagcatttgaaatcg

SEQ ID NO: 43220 - DNA, 402 bp, Homo sapiens
  misc_feature 345: n = A,T,C or G
aggaataaacccgcacaaatgtggtcatttgatttttgacacaggtgcaaagacaattcagtagagaaaggatagtctttttaacaaatggtactggaacatttaaacatacatatgcaggctgggcgcggtggctcatgcctgtaatcccagcactttgggaggccgaggcgggcggatcatgaggtcaggggttcaagataagcctggccaaaatggtgaaaccccgtctctaccaaaaatacaaaacttagctgggtgtggtggcatgcgcctgtaatcccagctactccggaggctgagacaggagaatcgcttaaacccgggaggtgggaaggttgccantgagcccgagatcgcaccactgcactcctgggtgacaagagtgaaactctgtctcag

SEQ ID NO: 43221 - DNA, 453 bp, Homo sapiens
  misc_feature 350: n = A,T,C or G
gagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatgggaagagggccaccaggaaaccctccccgaagaatgggtagaatcaatcatctgcgtggccctagtccccctccaatggctggtggatgaangaaaggaaatgtctgctctaagaagcagacaaccggacatgcgcattcatagcagaaggaaaccatcaagaagtggaaggctgaccatgatgagcagtagatg

SEQ ID NO: 43222 - DNA, 112 bp, Homo sapiens
  misc_feature 96: n = A,T,C or G
agtatgagaatgagtatctgaagattagctgtgagagagggcagagcgatggagggaacaatgtgggacagtgtgaagcatgtgatccaggggccncaactttttttggtac

SEQ ID NO: 43223 - DNA, 378 bp, Homo sapiens
gtgagatttccatcttggctggtcactccctgactgtagctgtaggtgaatgtgtttttgtgtgtgtgtgtctggttttagtgtcacgaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatatttaaatgctatataaatggggacaaatctatattatactg

SEQ ID NO: 43224 - DNA, 251 bp, Homo sapiens
  misc_feature 22: n = A,T,C or G
aacccggaaatgtaataaattnttatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagcc

SEQ ID NO: 43225 - DNA, 472 bp, Homo sapiens
ggattgcagaaactggccttccatctctctcagacaccaagctgcagatccaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtaagatgtccagaatgtctgtttccaggaaaaaggtcacctgcaggaacgggcagggcaactgctacaagagcaactccagcatg

SEQ ID NO: 43226 - DNA, 472 bp, Homo sapiens
cagatctcaatattgtttatgaactgaaataaaagtagtttgccaacatctctattttgacaacgcttgtaacccttatatgtataaaaatatcttttaaaagatgttttggatgatttgtgctgatttgtttttcttggatgtttgagcaattgactttcaatatgtttatatctaagtattttaaagaatgttttccctaagtttgaaatttccttgttttgagagtaaatggagaaaaaaaatatttttctgaatctatactttagaaaacactgagataagccaatagtaagatggtagacctagaagttaaatcaaaataatccacaagcaaaataaatataatggaccaaactcagcagtttaaaaactcagattgacagattgtgtttttaaaatatccagctatgtgtgatttacaataaaacatatattcaataaaacataaggacacagaaagattgaaaat

SEQ ID NO: 43227 - DNA, 472 bp, Homo sapiens
  misc_feature 333, 417, 421: n = A,T,C or G
ggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacttggtatccagctccagcaacttagagcgtttcacgtcacgccgggcgccaggcgtcggcttgtataacctgaaaacgctcctgtttttctcatctgtgcagtggggttttgattcccaccatggccatcacccagtttcggntatttaaaattttgtacctgcctagcaacagtattctcattcctaaagagattaatatgcagatctggcagaggacggaaattnaagngggagaccaaataacttttgccaactacagttgattattcatcagttccta

SEQ ID NO: 43228 - DNA, 182 bp, Homo sapiens
  misc_feature 10: n = A,T,C or G
atctgagttnaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagttt

SEQ ID NO: 43229 - DNA, 374 bp, Homo sapiens
  misc_feature 254: n = A,T,C or G
gggactctccttccgaacctggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaagggaagctgtgctgaatgggtttnggtggccactgagggtttgatgtggtttttatgtccggaaaagattataggccaagcggggcatcattggctatgatgttttgaagaccaatctttaacatctgattatatttgatttat

SEQ ID NO: 43230 - DNA, 143 bp, Homo sapiens
  misc_feature 11: n = A,T,C or G
cagtaagggtnagggctttcattttaagcagtgcccttcccccacagaaacacctactatgtgtgaggctctgggagcatcacaggaagaacccacaatcttttgtttctagttgccaaaaaagaaaaacaagatgagaatga

SEQ ID NO: 43231 - DNA, 469 bp, Homo sapiens
gctctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggcttttgtgttcaccaaggaggacctcactgagatcagggacatgtttgctggccaataaggtgccagctgctgcccgtgctggtgccattgccccatgtgaagtcactgtgccagcccagaacactggtctcg

SEQ ID NO: 43232 - DNA, 394 bp, Homo sapiens
  misc_feature 43: n = A,T,C or G
agagtacctaaatatgaaactaactagatttattggatatcantactttgagagttagaaatggttactgattgtcatcttttcagtgaagggttctatagttgagtaaaaaatttgtctaactttgtaagtatagtttatattgtagaaattgcttccaattttgttggtaacttcatgaagctattctaatttttttgtgattttagtgacttatataatattagtgacttagtagtttcatgtaaaatatcttcaaactaattagggcatgggttactcttttacctttggaaagcacattacatggtgtatatagtgcttattttttaaaattatagaaactgaaaaatttatataatatttaaaagaaaaatatcaatttttaattttt

SEQ ID NO: 43233 - DNA, 472 bp, Homo sapiens
ggagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgct

SEQ ID NO: 43234 - DNA, 117 bp, Homo sapiens; identical to SEQ ID NO: 28853

SEQ ID NO: 43235 - DNA, 178 bp, Homo sapiens
catatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccg

SEQ ID NO: 43236 - DNA, 344 bp, Homo sapiens
  misc_feature 6, 11, 340: n = A,T,C or G
agagtnaagtnagcctgtatccgtggggtgaaattaacagacatgtgggaattgaaccttaaacattctcagtttcactaggaacctaaaattataatcacgccacagagattgtaaatttgaaatttaccttgtttccatggaaattttgaattcaaaacatttaatgtgtaaaatatcactagtaagagggcacatagcattgggagatatacctaatgctaggtgacacgttagtgggtgcagcgcaccagcatggcacatgtatacatatgtaactaacctgcacaatgtgcacatgtaccctaaaacttaaagtataataaaaaaaaaaacattnttcc

SEQ ID NO: 43237 - DNA, 250 bp, Homo sapiens
ggtgtgcttccggtgcggaggtcaggggcaagatggtgccaccggtgcaggtctctccgctcatcaagattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgat

SEQ ID NO: 43238 - DNA, 345 bp, Homo sapiens
  misc_feature 247: n = A,T,C or G
ggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgtntgtcttgccctttttttagcacaaaaaaaattgtacttttttattgtcgaattgttttaaaagacttcattctttacttgttcttacgaaaaggatat

SEQ ID NO: 43239 - DNA, 249 bp, Homo sapiens
catcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgt

SEQ ID NO: 43240 - DNA, 438 bp, Homo sapiens
caagtcggaacagcagataacaatgcagcaaggccctgctgtccaatctccatctgtcaacaggggcgtgaggtcccaggaagtggccaaaagctagacagatccccgttcctgacatcacagcagcctccaacacaaggctccaagacctaggctcatggacgagatggggaaggcacaggggagaagggataaccctgcacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagcttttcagggccatggttcacattagaatgaaaaggt

SEQ ID NO: 43241 - DNA, 155 bp, Homo sapiens
  misc_feature 15: n = A,T,C or G
cattttgaaacaatncatggagacaacagtaaacagagtaggaactaaccgtactgattaaatacctgtaaataccgcaaggaagtttcacaagatagagtaggcaggagaatgaaatttcctgcgaccatgtacaatgtgtactccaccttagt

SEQ ID NO: 43242 - DNA, 292 bp, Homo sapiens
caacttcttagagggacaagtggcgttcagccacccgagattgagcaataacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttgggaagtgcagtctatgatgtgaaacactttgcctcctgtgtactgtgtcataaacagatgaataaactgaatttgtacttt

SEQ ID NO: 43243 - DNA, 404 bp, Homo sapiens
ggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttttaagagcatgcagccatcttggtgtgtgcatgaagtattgtctcttttgatatcagggattattttatttgctaac

SEQ ID NO: 43244 - DNA, 446 bp, Homo sapiens
  misc_feature 10: n = A,T,C or G
atgcaaattnagtttatcttcttgaaatctgctaaatgaatatatgttccatattttatctggttgtatgtattctaattgatcccttatgacttaaatttttacttaactgatttagcaagtctaccatcttctacctttgatcattccattgctgtatcatccatctactttccttttaactaaccaggtaagactaatcttatttaacatgcaaaccacttctgttgttatatagaaaattttatgtagtatctatggcctggatgtcactaccaacaaagccaatggcagtttgagtatatctcagtaatgttatctgataaattccttttattttcatgtaaattacctattgtttcataaaaggctgctttgtgcttgtatatggccaattctcttgaaaggttagtacattttatttgatgtacacatgtaagtattat

SEQ ID NO: 43245 - DNA, 472 bp, Homo sapiens
  misc_feature 22: n = A,T,C or G
agggcaaaaaggaaagaaaatntcagcataatgattaaaattggcaggcatcctacaggaaacaaacatcaagtgtgattacagaatttactgggaaaaactgaaatctgaagattaactctggctttggtaaactcagaactctatgcccagtcttgaaatggctagaaaattttagtgtcttggggagtctaagtaacatagaaccaatgcaaactcaatgaaacaagctcaaaaggtagtaaaaggtttcatgatgttctagaaaccagtgaaggaaatattcttgctacaaaaataaaataggaaatgaaaatcattgtgtgggaaaatagttaaggtattattatattaggggtccagtaaaaccttcaaaataaatccttttttggtttttcctggcattctcttaatataaatggaaagaatatgcaaaacactagtcagatgagttatttgcttgatccttgag

SEQ ID NO: 43246 - DNA, 329 bp, Homo sapiens
  misc_feature 7: n = A,T,C or G
gttaatnagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattg

SEQ ID NO: 43247 - DNA, 346 bp, Homo sapiens
  misc_feature 10: n = A,T,C or G
gtaaactagnattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattg

SEQ ID NO: 43248 - DNA, 379 bp, Homo sapiens
ctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgact

SEQ ID NO: 43249 - DNA, 311 bp, Homo sapiens
ggagagtgctgccccatctgcccaactgacctcgccactgccagtggttgtaatttatttatttcctgttcaacataaataaattacttgcaagcactgcaaacacgctcccatagatgctggtcgtctctgcaaagcagaggggctagttatccatgggacctggtagctggggtagaaaggaaaggccacttctcacttgcaggttgaaactgagtgaacgagcctgagacactagaggggtccttctttgcccaacatctccaaaaacatttgcttccaagacacatgaaggacagatgtgattctat

SEQ ID NO: 43250 - DNA, 376 bp, Homo sapiens
  misc_feature 313, 355: n = A,T,C or G
aattgagagcagtatcaaccccaggaaagcccatttccctacaattataatggtgttgaaaatactttgtctttgtgtaaacatggcccaaaaagaatgtgatgattcttttttctcaatttgtgggaaacatttttaaaaattcttttactttgcacctgtacactacttctcttccaagaatatttaagctttaagcactttccagtcattacttgatttgctgccaatgtgccagtgtttataatatgaaggaactgaggcaaaaagagccaaaatttcagaattaaaaaaaaaaagttgataacatganaatgtattcctggctcttagtctcttacagtttctctcaggnggtatgatgctaggttgatga

SEQ ID NO: 43251 - DNA, 198 bp, Homo sapiens
  misc_feature 7, 12, 83: n = A,T,C or G
cgggaantcggncttaggccgggggtctcttgttgaaatccgaatttcttgggtgaaaaatacatccgcagggttcggatganaccaggtgttgcttgttcagtatctcaagcccggaaagatgaattaatccttgaaggaaatgacattgagcttgtttcaaattcaccggctttgattcagcaagccacaacagtt

SEQ ID NO: 43252 - DNA, 217 bp, Homo sapiens
  misc_feature 27, 68, 82, 85, 89: n = A,T,C or G
aagaagcaagtttggtcttgggagacnaattttttagtaccaaatgtgtccattcctctccacctggncttgggaggtgtangcncatntctggcagagggtgcctcaaaccctaacaaagtcagctttccttcttcctgccaagagagggcattaattaaatacagccctatcattttggacagtgtaaattcactcgtatgtgggtccactgtat

SEQ ID NO: 43253 - DNA, 333 bp, Homo sapiens
gacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaaga

SEQ ID NO: 43254 - DNA, 183 bp, Homo sapiens
agaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagca

SEQ ID NO: 43255 - DNA, 179 bp, Homo sapiens
atgatatatgaattatatctcactagagctgataaaaattatatgtgacagtcacatatatttcttccatatgctcgcgaaaatatttgttcctttttttatatatttgaagtacaattggggagacctgtgaaaaaattatctggaaattattagtgtttccttaaaaaattattttc

SEQ ID NO: 43256 - DNA, 118 bp, Homo sapiens
  misc_feature 91, 103: n = A,T,C or G
ggagggtgctttattgggtggagggcaccatgtcccagggctatcaaataaagaatagtttggttttttttttaaataaaggttttattancatttgcccaanaaggcagatcctttc

SEQ ID NO: 43257 - DNA, 454 bp, Homo sapiens
acatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatg

SEQ ID NO: 43258 - DNA, 200 bp, Homo sapiens
  misc_feature 19, 23: n = A,T,C or G
gattttttgaaatttaatngtancagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataact

SEQ ID NO: 43259 - DNA, 247 bp, Homo sapiens
  misc_feature 23: n = A,T,C or G
ctggagctggagatgaactcggnacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgt

SEQ ID NO: 43260 - DNA, 266 bp, Homo sapiens
  misc_feature 31: n = A,T,C or G
caaggtcgtgcgtctgaagcctacaagaaantttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcccc

SEQ ID NO: 43261 - DNA, 318 bp, Homo sapiens
  misc_feature 28: n = A,T,C or G
gctagcaagtcaatcagaactttttttnccccgtctacaatattttgtatttataactgtaaattagtgtatagtgtttcactccagagacttcaataatatagtgttatcaaaggacttgtacagatttcagagaaagacaaatttagaagacggaggattctctattatgtgctatctgagagtcagtatgaaatgtcaaatccaaaagtacataatttagaggtctatttcaaagtaatcatttgagcatagtttctccactgtcagagacgactgttattttattttcaatcaaattaaaacttgtttttatgc

SEQ ID NO: 43262 - DNA, 139 bp, Homo sapiens
  misc_feature 18, 66, 139: n = A,T,C or G
ggatctcacaggctgagnaactcgttccctccaagcatttcatgaaaaagctgcttcttattaatnctacaaactctcaccatgatgtgaagagtttcacaaatccttcaaaataaaaagtaatgacttagaaactgcn

SEQ ID NO: 43263 - DNA, 269 bp, Homo sapiens
gtctacttctaagccctgtatgtttctgattgcaaggtgggatctatttttgcactttttaaaaacttgaggctgggcacagtggctcatgccttaatcccaacactttgggaagccaagcagggtggatcgcttgagtccaggagtttgagaccagcctgggcaacatcgtgaggcccccgtttctaccaaaaaaatacaaaaaattggccaggtgtggtggtgtgtgcctatagtcccagcctcctgggaggctgagctgggaggat

SEQ ID NO: 43264 - DNA, 306 bp, Homo sapiens
  misc_feature 24: n = A,T,C or G
ctgtgagcccttaagcaattaatnagacccaaagaggagaatgtggaaaccccaacttgaagccagttggtcagaagttctggaggctcagacttgtaactggtggggaggagggaacagtcagtcttgtgggactgggccctcaaactgtgagatctgatgctatttccgggtggagagtgtttgaattgaattggaggacacctagctgatgtctactgcttgatatgtagggggaaatccccacacgtttggtctggtcacacaagtcttctgtgttgatgatgatggttgtgatgtgagaat

SEQ ID NO: 43265 - DNA, 471 bp, Homo sapiens
ctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattaga

SEQ ID NO: 43266 - DNA, 469 bp, Homo sapiens
atctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgttccaacaggcccttcctgatgatcattgtccctacagacacccagaacatcttcttcatgagcaaagtcaccaatcccaagcaagcctagagcttgccatcaagcagtggggctctcagtaaggaacttgaaatgcaagctggatgcctgggtctctgggcacagcctggcccctgtgcaccgagtggccatggcatgtgtggccctgtctgcttatccttggaaggtgacagcgatt

SEQ ID NO: 43267 - DNA, 444 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaag

SEQ ID NO: 43268 - DNA, 243 bp, Homo sapiens
gtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatg

SEQ ID NO: 43269 - DNA, 336 bp, Homo sapiens
ggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttg

SEQ ID NO: 43270 - DNA, 103 bp, Homo sapiens
  misc_feature 6: n = A,T,C or G
tcccantctctgtgtgtatctgcatagcacaaagcaaaaaacaaactcctgctttgcttttattgaagggtttccaggactgcatgtctgctcctgagctctg

SEQ ID NO: 43271 - DNA, 457 bp, Homo sapiens
ggtgtcgctccgccccagggaagaagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagta

SEQ ID NO: 43272 - DNA, 252 bp, Homo sapiens
tgttttgtgcctttgtgttcatgttttcggttttagttttaattttctcaaattcttgaagtgtttatcttcaggaagcagtttctccaatagtatgcaaatcccaaacctgggtcgtgaatgtattgctcagaatcttcaagaatataggagatttttcaatgtgacagaaggtaaaactttgtcttaaaaaagaaaaaaagttaaaaccttataaattatgaatgatatctctctgtaaagctgttattt

SEQ ID NO: 43273 - DNA, 126 bp, Homo sapiens
caatgtgtaaatacttttattatctaatactatcttacgtctaattagtgtagcatttacaagaaagaaaaattaagatcttaaaatcagtgattatctttttctaaataaaatatcaccagaatc

SEQ ID NO: 43274 - DNA, 443 bp, Homo sapiens
cggaattcagtgagcatcagttattccgcatttagaggtaaggaaaactcagggagaatcttgtgaatctcagctttgtgctagacatatatctctggggataaatttgctgcctcaactttaaccccttgactgctctgatgtgagacgacacccttacagtggctgccttgtatgtgaaacctacccttaactaacccccatttatggctgtaggatatgtaatataattactgggaggggactgtgttggactcttctgatggggcctttttggctgtgacaagccttagattagtgttggaagagaaggacaattcattccctccagtggagccccttctttaggcatatttagcttttaatggtatcataggcaataaccacttttaatttgcagatgattctttctcaaccagtagatgaaataatgatatcaaatg

SEQ ID NO: 43275 - DNA, 247 bp, Homo sapiens
gaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttc

SEQ ID NO: 43276 - DNA, 468 bp, Homo sapiens
atcttggaatattttaagcctcccttaagaatcaggaattagatgtctactatgtatgaaattgttgatactttcaaattacttgacctgacagtaatggaataaaaactcccctggagacagtgtgtaaatttaaaaagtaatgatatggttcccgtatttattttaaagattacattcaaaacaagtatttaaaatacatctttctttaggagttaaatacaatattacaatttttgtgttttagctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttctt

SEQ ID NO: 43277 - DNA, 358 bp, Homo sapiens
aatgcaaataacaaaactgcaacactatttttaaaaagataaatatctgagttaaaattactgaatctttattttacacctaaaaaaatatgagaacaaggtacatgcattatgtgtcacattactgggcaaactgttcaagtattttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttac

SEQ ID NO: 43278 - DNA, 154 bp, Homo sapiens
  misc_feature 151: n = A,T,C or G
ggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcanttg

SEQ ID NO: 43279 - DNA, 468 bp, Homo sapiens
ggttgccctggcaaagggtagaagagcagaggatggctctgtcattgattatgaactgattgaccaagatgctcgggatctctatgatgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgacta

SEQ ID NO: 43280 - DNA, 257 bp, Homo sapiens
catggaactgccttccaaacacttacttcacagtgttaatcggaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaac

SEQ ID NO: 43281 - DNA, 403 bp, Homo sapiens
  misc_feature 163, 169, 171, 230, 234, 237, 360, 384, 386: n = A,T,C or G
gtttgagatacaaccgtcttggtggcaggggcatagagtggtcagtctgaaagggaggctctcttaagagctatgtgccttccacccagagggagacccagtagaaagaaaaacatcctgggaaatccagctaccatggccctcccagtggaggatcttacanatttangngaatactttcaaagtatcctcagaaatgtattctgcacccccggccccgcccatgctgngggnggngggggagcagttgccaatatttgcaccatcttcacattgcacatgttgcaacaagagcttctgggaaggtaagcggcatcggagctagatcacgtttcacaattagtggttgttcttttccgngtttattttgcactttaaaaaaananagaacgcatgcaaatga

SEQ ID NO: 43282 - DNA, 307 bp, Homo sapiens
  misc_feature 12, 28, 31, 32, 33, 38, 39, 47, 50, 51, 59, 70, 71, 73, 75,77, 79, 87, 88, 89, 93, 94, 101, 178, 193: n = A,T,C or G
ggctgccccggngcgcacagctgttttntgnnncaacnncatgtttnctnnggggctgnaacctggaganntntntncnaatccacnnncttnnccggggnggcctgatccaattgatagggatgaggatgaacttgagatgctttctgaagccagagcccgcttggctaatactcanggaaagaaggccaanaggaaagcaagagagaaacaattggaagaagcaagacgtcttgctgccctccaaaaaagaagagaacttcgagcagctggcatagaaattcagaagaaaagaaaaaggaagaga

SEQ ID NO: 43283 - DNA, 438 bp, Homo sapiens
cacgtcccaaacataaaacccgccacgcccagtagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagcta

SEQ ID NO: 43284 - DNA, 300 bp, Homo sapiens
ggtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactga

SEQ ID NO: 43285 - DNA, 284 bp, Homo sapiens
  misc_feature 3: n = A,T,C or G
atnaacacactgttaaaatctgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgct

SEQ ID NO: 43286 - DNA, 364 bp, Homo sapiens
gtaaacatgtatgtgctgtacagaagaagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctgg

SEQ ID NO: 43287 - DNA, 177 bp, Homo sapiens
atggaaaccttatatatgacagaaagcattacaaatcagtggatacaatgaagtcttcaataaatcaaactggaacaatgtggggaaaatgaaatttgatatcctaccatataagaatcaattgtagttgggttaaaaacctaagtgcaaaaaagaaagactctaaaactctgattt

SEQ ID NO: 43288 - DNA, 200 bp, Homo sapiens
  misc_feature 78: n = A,T,C or G
ggagtaaaccatgtattcccttatcttttactttttttctgtgacatttatgtctcatgtaatttgcattactctggnggattgttctagtactgtattgggcttcttcgttaatagattatttcatatactataattgtaaatattttgatacaaatgtttataactctagggatataaaaacagattctgattccctt

SEQ ID NO: 43289 - DNA, 212 bp, Homo sapiens
  misc_feature 162: n = A,T,C or G
gtgaactcattttctgtttactcttgaaaaagttaattgccctttggtttggctaagacctatttgataacagatgcttaatgaatgattaataagtaataatgcgtgtggaaatcccaagtttgtttgcaatttaaaaaagttgaattcttccctagggcncccccccttttttaaagattaacaggctgtgtacaaaaagagggtctttg

SEQ ID NO: 43290 - DNA, 123 bp, Homo sapiens
agagacacacctacccacaagcctgtaagaaatattgatgatggtgctaaagaaaatgtgtgaagaaacagttcagaaagactgtcgtggcacatcttttcaaaatcattgactaaacacacc

SEQ ID NO: 43291 - DNA, 427 bp, Homo sapiens
ggtgtggtcgacgggtcctccaagaagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacggatcaacccacagaacaaagcggatttccaaggcatctccccagagcgagcctttgctgattttctctttgccagcaccatcctgcaccttgttgtcatgaactttgttggctgaatcattctcatttacttaattga

SEQ ID NO: 43292 - DNA, 185 bp, Homo sapiens
attccgctctcgatgtgagaggcacaggggaaatggcagctgagtgtctgtaaatgaatagctactgggatggcacaagggctcctaaagatcaaagaaccaagaccaaatcaacctctcgtcaggaaagctacctcaagtgtctatttattgatacataaagattgactataggggatatcaag

SEQ ID NO: 43293 - DNA, 387 bp, Homo sapiens
acctcgtgatccgccagcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaataagtttggaccttgtgcctcctgtgggaggctgaggactgcaagaggaga

SEQ ID NO: 43294 - DNA, 214 bp, Homo sapiens
caacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcgtctaaactgagtccagctgcctaattctgaatatatatatatatatatcttttcaccga

SEQ ID NO: 43295 - DNA, 127 bp, Homo sapiens
  misc_feature 56, 60, 67, 126: n = A,T,C or G
ggaaaaaaaaaaccttttaaactggagagacttctgacaacagctttgcctctgtnttgngtaccanaatataaatgatacacctctgaccccagcgttctgaataaaatgctaattttggatctnc

SEQ ID NO: 43296 - DNA, 136 bp, Homo sapiens
gcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaac

SEQ ID NO: 43297 - DNA, 315 bp, Homo sapiens
acaaagcaaccagaaggaccctggtgtccttgaccgcatgatgaagaaactggacaccaacagtgatggccagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcactttttt

SEQ ID NO: 43298 - DNA, 349 bp, Homo sapiens
cataaagaacctattctgtctatatactattctacatgggcaggagtatttttctagaagacattattacatataaatctacagtgacaatgcacctgctgcatggatgaaccttgaaaacatgctaaataaaagaagccagccatctgggtgcggtggctcacgcctgtaattctagcactttgggaggccaaggcgggcggatcaagagatcaagactatcctggccaacatggtgaaaccccgtctctactaaaaatacaaaaattagccaggagtggtggcatgtggctgtagtcccatactcgggaggctgaggcaggagaattgcttgaacttgggagttaga

SEQ ID NO: 43299 - DNA, 223 bp, Homo sapiens
cacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaac

SEQ ID NO: 43300 - DNA, 398 bp, Homo sapiens
atggattcagtagtatctgtgttaactaactcctgagacttgcttcatcttgctttgcacttcttaatttcatgtagagtctatgacaggaggtagagctggttaaagccaaaagctgctgaataacacgaattattcagtctaccagctttttaccagcctcattattctccaagggcatcttcttgaacctgagcccagttgtcctgaaaacttaggaagccagaacttgttattgccttatttcaacctcagtggtctctggttcaaacttaaatgatgcctttttacctgggctcaacagcttgtaggccctccttctatgtataaatacagcatatagataataagtgggatgtttgatgctctatgctcccttcaggtcattaaaataaaga

SEQ ID NO: 43301 - DNA, 155 bp, Homo sapiens
agcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaatt

SEQ ID NO: 43302 - DNA, 415 bp, Homo sapiens
agcactttgggaggccaagaggggtagatcttttgagaccagcctggccaacatagcaaaaccccatctctgctggtaatataaaggttagctgggcgtggtggtacatgcctgtggtcccggctgctcggggggctgaggcaggagagtcatttggacccgggaagtggaggttgcaggtggagtgcagctgagatccagcctgggtaacagagtgagactgtgtctcaaaaaaaaagaaaaaggttgccatcctgagtttgatagcctacaatgagctggactccaagctaagtgcttttaatgctctttcctctgtctgtctgtctgtctatctcactcttttacccaggctggagtgcagtggtgtcatcctggctcactgcaacctccacctccaggagagtcatttgga

SEQ ID NO: 43303 - DNA, 170 bp, Homo sapiens
  misc_feature 8, 12: n = A,T,C or G
gagtaagnaagnactgttaattgctcgtataggtaaaaactagtcgcgcaagcagcacagattaagaaatcaaaagcaaagcttgctaatccctctatagttactaagaaaaggaacaaacgaaatcagacaaataaactagtagatgatggaaaaaagaaaccaagaac

SEQ ID NO: 43304 - DNA, 336 bp, Homo sapiens
  misc_feature 24, 173, 323: n = A,T,C or G
agttacggcccctgccctaaatgnacctgcaatctcaccggggaaaggaacgggcatggactacctgtatgcaggtcagaaagtgaggagtgttccctgtccataacacttagagccctgctggcgagaagcagtgagaatgctgtgcatatatctaccctagggtagatcangaaaaggtctcatgaaagtggagatactggaactgggttttcaaggatggatatgatggaaacatggagaagtaggagagagacaagtggaatcacagaacaaagacacttgtgtgggagatcaggagacatgaatgggaaatggcatancttggctggagtg

SEQ ID NO: 43305 - DNA, 358 bp, Homo sapiens
gactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggtctcctgagaactt

SEQ ID NO: 43306 - DNA, 421 bp, Homo sapiens
aatgacctaatttattaatctgaagattaaccatttttttgtcttagaatatcaaaaagaaaaagaaaaaggtgttctagctgtttgcatcaaaggaaaaaaagatttattatcaaggagcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaaga

SEQ ID NO: 43307 - DNA, 139 bp, Homo sapiens
ggcaaggtgagggataatattaggagaaatacctaatatagatgacaggttgatgggtgcggcaaaccaacatggcacacgtatactgtgcaacaaacctgcacgttctgcacatgtatcccagaacttcaaatataat

SEQ ID NO: 43308 - DNA, 423 bp, Homo sapiens
  misc_feature 6, 12: n = A,T,C or G
gaacangtgagnaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggtaagtgaaacttagtggatgagttaatgacctggtttgagccatgacaaagctttgtttgtagatggggaaaggctttgtgaggacactggaaaggtatttcttgtctgggaaaccctgctgtggtccccagatttccaacctgttagtgaaagacggtgtgggtccaagagggaaaga

SEQ ID NO: 43309 - DNA, 140 bp, Homo sapiens
aagaagaaaaaggttggagtaataccccctaagaagttcatcacaagattacggaaagaaaatgagctttttgacaactacatgcaacaagatgcccatgaattcttaaattacctactaaatacaattgctgatatttt

SEQ ID NO: 43310 - DNA, 286 bp, Homo sapiens
  misc_feature 278: n = A,T,C or G
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctactttttatcctcatttaaaacgattttccagttcangggcagta

SEQ ID NO: 43311 - DNA, 468 bp, Homo sapiens
tcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcccttcctgctttggggctttagaattctaattgtcagtgattttgtatatgaaaacaagttccaaatccacagcttttacgtagt

SEQ ID NO: 43312 - DNA, 337 bp, Homo sapiens
tatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtattt

SEQ ID NO: 43313 - DNA, 466 bp, Homo sapiens
  misc_feature 21: n = A,T,C or G
actgaaaaaaaactgcagagnatcaaagaaggtaaaaattgatagaaaaaaactcacaacgattttttttcccacaagaccatgcagataccatactatccctttaatgaaagatgaaatattgctaacatgtcagttcttcccaaattgatttataaacctatgttttctatcaggatatttacatatattaatttaccaattattagcatgaaaggaaagaggacaaggaaagctaaaacaatttgggaaaggaaatgatccaaattggagaacttccactgcgtgatttcaagactgccattaaagccacaaaaattaaaacatggcattaataaaaggataggcacaaagattaataccatgtgtagctttggaaaataatgtatactaatatgactaatgtcccagatcatttaatgaaaagacttcgcatttttcccatcttggggagagaatgcgaagt

SEQ ID NO: 43314 - DNA, 427 bp, Homo sapiens
  misc_feature 26: n = A,T,C or G
tcttttcaaggttttttggaggctcntttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggctttaaaagcagtagtaactgccccaccaaaggtcttaaaagccattttcggagcctattgcactgtgttctcctactgcaaatattttcatatgggaggatggttttctcttcatgtaagt

SEQ ID NO: 43315 - DNA, 313 bp, Homo sapiens
  misc_feature 254, 305, 312: n = A,T,C or G
gacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctnccttcctaatttcatgcaaaagccctttagtacccgctggaagaccccccngaatggng

SEQ ID NO: 43316 - DNA, 150 bp, Homo sapiens
gtggtgttgaagtgctgtctagtgtcactaagagcaagaaagctgtgatgtaccttatggagaaaatactgttagaaaagtttcatttaggcatgaagttataatgttcttggtgtaagttcagtattaatgaatcaacattatcgtaca

SEQ ID NO: 43317 - DNA, 443 bp, Homo sapiens
  misc_feature 7, 8, 33: n = A,T,C or G
gaaatgnngctctgccatgttggtggttatttnttgtcgtgaacaagagctcaggcctggtttccaggtgtgactttattgcaccctcgccctacctccccggcttgagaattctggaaaataccacaataagtgtttcttttctcttttgagattatgtaaataatacttgcctccatgctcttaaaagaaaatgacatctctatttccatgtgttgcggtgtttcctggtttgggaccccaccagctatccagtcacccaggcttgaagccaggttcttcccagcttctctctccaccctgcccatccctgtgcatgtagcagtgaccaggtcctatcgattatctgattatctgccggaagcctcaggaatgggagccttctgagtcagcacatcaccaggagcacggcctgtggccaggctgctcaggggctggtgatg

SEQ ID NO: 43318 - DNA, 252 bp, Homo sapiens
  misc_feature 42, 43: n = A,T,C or G
tatggcccggggggaggccggggcacgtggattgcttgagcnnaggaatttgagaccagcctgggaaacatggtgaaacctcctctctacaaaagtacaaaagttagccaggtgtggtggagtgcacctgtagtcccagctacttgggaggctgaggtgggaggatcacttgagcctgggaggttgaggctgcagtgagcggtgattaagccattgtactccagcctggacaacagagtgagaccctgcctt

SEQ ID NO: 43319 - DNA, 425 bp, Homo sapiens
tcaccctcctgagtagctgggattataggcctgcgccatcacgcctggttaatttttgtgtttttagtagagatggggtttcaccatgttggtcaggctggtctcgaactcctgaccttgtggtctgcctgccttggcctcccaaagtgctgggattacaggcatgagccactgcaccgggcctatggttttcttttttttctggccatatcctgcgtgagataaatctattgccttttccccaatgcatgcttttgtgacatcatccgttaatcacttggaaaatactggctgactgaggtatgcagatcttttaaatgttgacacatatcattatacaatatctaaaaaaacattaatatctcattagaaaagtctttattgcagccttttatgcttcttagtggcagatacaaattttaaga

SEQ ID NO: 43320 - DNA, 392 bp, Homo sapiens
attcattgacaatcaaaatttcctgaattttatatttttttaaagttttgtttttactttcttttattttttatttttattttttgagacagagtctcactctgtcactcaggctggagtgcagtggcacagtctcagctcactgcaacctctccctcctgggttcaagcaattctcatgcctcagcctcccaagtagctgggactacaggtgtgcatcaccacactcggctaatttttgtatttttagaagagacagggtatctcctgttggccaggctggtctagaactcctggcctcaagcgatctgcctgccttggcctccaaaagtgctgggattataggcgagagccaccacatccggccttatttaattaattcaccaaataaag

SEQ ID NO: 43321 - DNA, 467 bp, Homo sapiens
  misc_feature 34: n = A,T,C or G
atctggcaaagcggtctgcccctggaggtggttncaaggttccacagaaaaaagtaaaacttgctgctgatgaagatgatgacgatgatgatgaagaggatgatgatgaagatgatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgattgaccaagaggctattcaagatctctggcagtggaggaag

SEQ ID NO: 43322 - DNA, 125 bp, Homo sapiens
caaggcagtatgtgacagcaagggccaccacccctgctccttcggaggacgtgccctcacccctcactggtccactggcttgagactcaccccgtctgcccagtaaaagcctttctgcagcagcc

SEQ ID NO: 43323 - DNA, 380 bp, Homo sapiens
  misc_feature 7, 375, 376: n = A,T,C or G
aggactngcgaggaggagttgagagaacggatcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcatannaaac

SEQ ID NO: 43324 - DNA, 243 bp, Homo sapiens
gttaagcactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataag

SEQ ID NO: 43325 - DNA, 183 bp, Homo sapiens
gaaactaattggaacaaagatacaacataccttaatctctgggacacagctaaaggggtgctaagaggaaagtttatagctgtaaatgctcacattaaaatttagaaacatcttgaattaacaacataacatttcacctagaggacctagggaaacaagagccaaccaacccccaagctagca

SEQ ID NO: 43326 - DNA, 308 bp, Homo sapiens
  misc_feature 37, 65: n = A,T,C or G
tagggggagccgcatgaaggctcccaagggagacganaaacttgccgctcaaaatgggcaccagntcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtg

SEQ ID NO: 43327 - DNA, 343 bp, Homo sapiens
ccggcggtgacgacctacgcacacgataacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcatggcttacagaaggatgttccttcaggaggaagcagcactaaaagcactctgagtcaagatgagtgggaaaccatctcaataaacacattttggataatc

SEQ ID NO: 43328 - DNA, 487 bp, Homo sapiens
  misc_feature 418: n = A,T,C or G
cattgcttcacatgcaccgtaactggaatattagcacagagtgtgctcaagaaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaangaagttgcctctgagctccatctctctgcgctgctagacatggtggacatttgagcagcctgacctgtg

SEQ ID NO: 43329 - DNA, 273 bp, Homo sapiens
agcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgat

SEQ ID NO: 43330 - DNA, 442 bp, Homo sapiens
  misc_feature 28: n = A,T,C or G
aacagtccgagtggagagagcgagcttngtggttgtgtggtcgcgtctcggcaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatga

SEQ ID NO: 43331 - DNA, 392 bp, Homo sapiens
aagaaagctcagctggtggtgattgcacacgacgtggatcccatcgagctggttgtcttcttgcctgccctgtgtcgtaaaatgggggtcccttactgcattgtcgggggaggggcaagactgggacgtctggtccacaggaggacctgcaccactgacgccttcacacaggtgaactcggaagacaaaggcgctttggctaggctggtgggggctgtcgggaccaattacaatgacagatacgatgagatccgccgtcactggggtggcaatgtcctgggtcctgggtctgtggctcgtatcgccaagctcgagaaggcaaaggctagggaacttgccactaaactgggttgaatgtacactgttgagttttctgtacataaaaataattg

SEQ ID NO: 43332 - DNA, 335 bp, Homo sapiens
acaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggat

SEQ ID NO: 43333 - DNA, 447 bp, Homo sapiens
  misc_feature 33: n = A,T,C or G
aagtgtcatataaaacagttgtttatgatcgtnttgcctgaccttcaccaaccatgtacagaaagcacacgggacagatgatgttattaatcgtttcatgggcccccttggtctagaatataaaggctggtccttggcactgctttatgcccatgttccctatgctgaagccatggtccgttagtccttgaatacaccgtgtttgttcagttctgtgccttcgtacatactctcccctccttggagtgactttatctcttgtcttcctagtcagctcttacatggcttttgaaattcataaattttactttctctgggtagcctttgtagtctcctctggcaaattttcttccttctctttctttatcttctgttaggccatagcacttttgaaatgtttctatttatagcacctgttatatcactgtaacctgtatgttggcatga

SEQ ID NO: 43334 - DNA, 471 bp, Homo sapiens
  misc_feature 20: n = A,T,C or G
aagaaagcggaggcaacagnataacaaggagaaagtagaaattaagggaagaaaatcatatgccagcgaagtggagagaaacatagatcattatagccctaaggccatcaagttaggaaagctgttctctgacagccactatactaataaaatctctatattaaaacctaatgaattgagataagagctgtgtaaattaataagcatttgaattaaagtccattcttttaaaagtagctttattacttgttcagaatatttagaaatgaaaactaggttgagaatcacagagaactttagacatctaaataattaccttactttattggaggctcagattttgtgagttacagctagttatgggcagagttcaatacagtagtttttctactgtatagcatacattctggaaagacaaattgctaattatttttttctatgaattttctaagtatctactgaggtatactg

SEQ ID NO: 43335 - DNA, 464 bp, Homo sapiens
  misc_feature 6: n = A,T,C or G
attgcnggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttga

SEQ ID NO: 43336 - DNA, 365 bp, Homo sapiens
ctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttca

SEQ ID NO: 43337 - DNA, 454 bp, Homo sapiens
  misc_feature 57: n = A,T,C or G
gctttccctgtggcagcagccgggctgagatagcgtggctgtctcctctctccgccntggcgtgtgctcgcccactgatatcggtgtactccgaaaagggggagtcatctggcaaaaatgtcactttgcctgctgtattcaaggctcctattcgaccagatattgcgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccct

SEQ ID NO: 43338 - DNA, 359 bp, Homo sapiens
gtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaaatgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttat

SEQ ID NO: 43339 - DNA, 435 bp, Homo sapiens
atttctcttaagattagtgatgttgagcaccttttctatacccgatggccatttgtatgctttttaaaaaatgtctattctgccgggcgtggtggctcacgcctgtaatcccggaactttgggaggcaaaggcgggtggatcacttgaggtcaggagttcaagaccagcctggccaacgtggtgaaacaacatctctactaaaatacaaaaattagccaggcgtggtggggcacgcttgtaatcccagctacttgggaggctgaggcaggagaatcacttgaacccaggaggcggaggttgcagtgagcagatgcaccattgcactcctgcctgggtgacaagtgcgaaacttcgtctcaaacaacaacaacaacaacaaagtctattcaaggctgggtgcggtggctcatgcctgtaatcccaacactttggga

SEQ ID NO: 43340 - DNA, 403 bp, Homo sapiens
  misc_feature 32: n = A,T,C or G
cagagtctcgcttccctgaagaactcactcantaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcatt

SEQ ID NO: 43341 - DNA, 405 bp, Homo sapiens
  misc_feature 33, 34: n = A,T,C or G
gttcagcctgtggcggttgctggtcagtaacanncaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaac

SEQ ID NO: 43342 - DNA, 386 bp, Homo sapiens
  misc_feature 7, 13: n = A,T,C or G
attcccnctaatngtgttttttctttgtattttactgctcccttcttatctaaatccaccatcaattagtgtcttaaaagattttgctgctttagccactgtaatggggtttggagactggcagaagaataaaaccaaaataagtatgttttagataaatgttaatatgtatatattgagtcacaaggtattaatctgatattagcaaatcatgacttcataccatgccattatattaatatagtaaatcttaggtttagcattgacttctgatttctagaacctcactctatctgtaaattgttcattccagttataaaagtaatgaagtatatgaaaatgtttctgttgtcatttgtctatatcagaacgcataagttatgaga

SEQ ID NO: 43343 - DNA, 465 bp, Homo sapiens
  misc_feature 5: n = A,T,C or G
atggngctgtactttctgcagcacagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggtagagaagctgagtacttctttgattccaga

SEQ ID NO: 43344 - DNA, 183 bp, Homo sapiens
  misc_feature 7: n = A,T,C or G
caatganacagaaaattaacaagaatattcaggacttgaactcagctctggaccaagcagacctaataggcatctacagaagtctccaccccaaatcaacagaatatacattcttctcagcaccacatcacgcttattctaaaattgaccacataattggaagtaaaacacttctcagcaaat

SEQ ID NO: 43345 - DNA, 396 bp, Homo sapiens
  misc_feature 3, 6, 31, 184, 186, 187: n = A,T,C or G
canaanccttgcctgtagtgtgccctacagnttgcagactacatatgttcatggttcccatctttgtaaactttaaaagaaagctcttcttttaaagtagattagaaatatgacaattgagcattctgtaagtgtgtgaggtaattactgtgagtgaatattagagtgaatgaagcaaacaacntnncaagccaggagatccgcctcgtagtccaggtgttgccccacttctttactgtggaattttcacaaaccccttatacttctgacaccagttgccatacctgtgaaaaaagagttgcattaaatgatttctggagtcccgttcagtttcaaacctcattcaggtctgcaaagtgaatatgtcagattgtattaaataaaggtaggattgct

SEQ ID NO: 43346 - DNA, 310 bp, Homo sapiens
atctaaactggagtgatgttagcaccacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtagga

SEQ ID NO: 43347 - DNA, 490 bp, Homo sapiens
  misc_feature 6, 11, 32, 34: n = A,T,C or G
gagacncaagnatggcggacagtgcggaactntngcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttacttggatgaactgataaaacccaccagtctagcagaaatta

SEQ ID NO: 43348 - DNA, 127 bp, Homo sapiens
  misc_feature 4, 29: n = A,T,C or G
ctgngtgcagtggctcatgcctgcaatcncagcactttgggagaccgagttgggtggatcacttgaggtcaggagtttgagaccggcctgaccggtgtggtgaagccccgtctctactgaaaatacg

SEQ ID NO: 43349 - DNA, 416 bp, Homo sapiens
  misc_feature 14, 21, 66: n = A,T,C or G
caccacagggaacntcggttnttatggccggaaggaagcaacgcaaagctgagaacatggacgttnatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatg

SEQ ID NO: 43350 - DNA, 313 bp, Homo sapiens
  misc_feature 30: n = A,T,C or G
caaacatgtggctgtggatttcacccaggnaggtagtggcggcaactggaccctgatgagaagataacatacggggatgtgatgttggagaactacagccatctagtttccttggcctatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctggtaagttagtagagtacca

SEQ ID NO: 43351 - DNA, 339 bp, Homo sapiens
atatcaatgttgggaatgtaaaatggtgcagtcactttagaaaacagtttggctgttctcaggccggatgtgatggctcacgcctgtaatgccagcagtttgggaggccaaggcgggtggatcacctgaggtcaggagttcgagaccggcctgggcaacatggtgaaacccagtctctactaaaataggaaaattggccgggcatgatgtcgggtgcctatagtcccagcttcttgggaggctgaggcaggagaattgcttgaacctgggagacggaggttgcagtgagccaagatcgtgccattgtgctgcagcctgggcgacagagtgagcccgtct

SEQ ID NO: 43352 - DNA, 445 bp, Homo sapiens
tgacaaaccatttccacagcaacacagccactaaaatacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccgggggagaggcattgccttctctgcccacagtctttccgtgtggttgtctttgaatctgaatcagccagtctcagatgccccaaagtttcggttcctatgagcccggggcatgatctgatccccaagacatg

SEQ ID NO: 43353 - DNA, 247 bp, Homo sapiens
  misc_feature 24, 242, 246: n = A,T,C or G
agggaacctacaggttacaacagnatttgtgatctcagccaagcacagtggtggcagggcctagctgctacaaagaagacatgttttagacaaatactcatgtgtatgggcaaaaaaactcgaggactgtatttgtgactaattgtataacaggttattttagtttctgttctgtggaaagtgtaaagcattccaacaaagggttttaatgtagattttttttttttgccccccatgctgtngatng

SEQ ID NO: 43354 - DNA, 451 bp, Homo sapiens
  misc_feature 41: n = A,T,C or G
tgagacagggtcttgctgtgttgcccaggctggagtgcagnggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttggga

SEQ ID NO: 43355 - DNA, 209 bp, Homo sapiens
  misc_feature 29: n = A,T,C or G
tgcagacgaagcggcgggctctggagaanattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccact

SEQ ID NO: 43356 - DNA, 242 bp, Homo sapiens
gcagccttctgaatatcttataatttttttgtgacatgctcttcccctagtgggcttcatcattcaggctgctctcctcccctcactgatcagagcttataggccttctgatgaatccatcctctacaagctatggggacggcctgcattcttgcctacgaagctgcagctaaatagaaaaagcacatccagaatgaccactaaaaagagaaaaagcaaaagcagtttccagatccatgaat

SEQ ID NO: 43357 - DNA, 465 bp, Homo sapiens
  misc_feature 29: n = A,T,C or G
gagtatttttaacgacatctctaatattntgctgatgcattttgatgctttgtgcattcatttctttctgtgctttgttggaatctggctatctgcttacagctattgaggaaactcagctttttaggagtgtttacagcctttttcatacctaaataggatgaacagtggatataaacttgccaaggcagaaatgtgttgataaatcaaaatgtgtatttgtggagggttgtgcatctcttggttgcagcttgctaaataggccatttaggaatcttctttcaatgcttttttcttgagcactgcctggggtggtgaaaaagcagagggcaagcctttgtctgacgccaaaaatgtcttcagtgaagaggccaagaggaaggcctccatcttccaagaagagcgatggttctgggacatatactaagttgcagaatacccaggtgagggtcatgtctgagaaga

SEQ ID NO: 43358 - DNA, 449 bp, Homo sapiens
atgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcgcaactgtacaggagagtggcctttctacagcacattttcagtaatcctatatttagtcaaaatggatgagaaatcatg

SEQ ID NO: 43359 - DNA, 362 bp, Homo sapiens
attcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatac

SEQ ID NO: 43360 - DNA, 469 bp, Homo sapiens
  misc_feature 38: n = A,T,C or G
agagctctaactttctactgatctagctaattgaaatnagtatatttttagaaaataaacttgaaatatgaccaagattttgacaacttcttatatagtccacttaacctgccaatttctgatgtcttttgaaaatcatagcatacatcagaaaaaataggattcatgaccattgaagttctaggtaagaatctttaaagatatataagcctaaatagtttgtcattatttctataaatacagatggataaagaaataaattatgaaagaagataatacaatattaaaagctgtattttctagagctcctggaaagatggaatttttcttaaaagaaagattcagggagtaatgaaaagaagtcttcccaaagttttgaatatgtaattcaacaggaaacagaaaaattttttgtaaataacattctaaaaataggtgttaaataaaaagtatctatagcagaaagaag

SEQ ID NO: 43361 - DNA, 391 bp, Homo sapiens
tggacattggctgctcacttggggcctgccctgggctacttactactgaggatgcacaaaggatcttcccaccacggactaggagacagtgcccttgtcctcatgttgttcacatactggtcggtgagggatgggtctgagtacatgataaatccctgggccccataagatttgactaggaggggtaagggcctggtgaactgctcagaaaataaactgtgttgtcagcaggaggacccctttctactatgagatactgcattccctgctaatcatacttgtgctctatctgttgatagaacaaatacataatgggaaacagccactgtgctttcagaagaacacacttgaaagaatttgttctcaataaattacatctgcatctggatac

SEQ ID NO: 43362 - DNA, 226 bp, Homo sapiens
tgaatgtgaaccgtggcctgaagaaatggagagtaaatggtgatgaggtattgccgtaagttgtgttttctgttataactaagtcttgacttacccatggtaattctttcttacaaaccttccatatatgtgtgctggtttctattcctgatgctgaactgttagttttctaatatttaacttttggcttccaaaactacatgaagttatttttctaaagaaagac

SEQ ID NO: 43363 - DNA, 144 bp, Homo sapiens
cacaaaggagtgagtgaaactcccaccctacccccttttttatataataaaagtgccttagcatgtgttgcagctgtcaccactacagtaagctggtttacagatgttttccactgagcatcacaataaagagaaccatgtgcg

SEQ ID NO: 43364 - DNA, 472 bp, Homo sapiens
ctattaagacttacttgcattgctggactagcaaaggaaaattgcactattgcacatcatattctattgtttactataaaaatcatgtgataactgattattacttctgtttctcttttggtttccgcttctctcttctctcaacccctttgtaatggtttgggggcagactcttaagtatattgtgagttttctatttcactaatcatgagaaaaactgttcttttgcaataataataaattaaacatgctgttaccagagcctctttgttggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaat

SEQ ID NO: 43365 - DNA, 462 bp, Homo sapiens
actctgggttgagattggatggagccagttatggagcctttgcaatgtgcttactgcaaaaaaccctctgttttcttctgccccctaacactctcagtgtgactgaagagatttttgtctaccaagtgaatagtattggctattgagttttcccatttatattactcatttttattactcctttcattactcaaggactactagtcagtgactcagcactcccaatcagcatgaatattatacccctgagtggatggaattccacctccttaagaagaaaaaaaatgttgttttagatagcttgaacaatgattttcttggttatttaaaaacctaggcagcagagtttagacttgttctagaaagcccaaggaagtcattgcagctctttaagcagagaaatagcatgcactgtgagcataccataaaactgtccatattgtttgtgggggtggcagaaga

SEQ ID NO: 43366 - DNA, 472 bp, Homo sapiens
aggcgaggccagcagtgatgatgatctctttcgtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaaggtttgaacacaaggtgtccaacatctttgatg

SEQ ID NO: 43367 - DNA, 351 bp, Homo sapiens
  misc_feature 8: n = A,T,C or G
tactgttnaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtg

SEQ ID NO: 43368 - DNA, 182 bp, Homo sapiens
  misc_feature 122, 144: n = A,T,C or G
attgtaagtctgtgtacatccgtgattgttttggtttctgttccctttctgactgcccaaggggctcagaaccccagcaatcccttcctttcactaccttcttttttgggggtagttggaanggactgaaattgtggggggaangtaggaggcacatcaataaagaggaaaccaccaagctg

SEQ ID NO: 43369 - DNA, 134 bp, Homo sapiens
cacagaacccagtaagttatgccaagggtaactgtgtgaactgtgttcgatactgggctatgtatgtttcttattcattgccaatttaatacctaagtttatctaactttacaataaagctttttttcccctat

SEQ ID NO: 43370 - DNA, 467 bp, Homo sapiens
aggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcg

SEQ ID NO: 43371 - DNA, 451 bp, Homo sapiens
tatagaagcatttgaacctcttgcgtaggggctgggaacactgaggctgagacctgttgggctccattcctaggaggttaaggtattcttagtcacaggatgagacaggaggtcggcgcaagatacaggtcacaaataccttgctgataaaacaggatacggtaaagaagctggccaaatcccaccaaaaccaagaaggctatgagagtgacctctggtcatccttattgctcagtataagttaattataattcattagcatgctaaaagacacttccaccagcgccatgacagtttacaaatgccatggcaacgtccagaagttacgctatgtggtctaaagtggggaggaaccctcagttctgggaattgcctgcccctttcttggaacactcatgaataatccaccccttgtttagcatataataaagaaataactatatttatctga

SEQ ID NO: 43372 - DNA, 470 bp, Homo sapiens
gctgattttgaggaagaataaggggtggcaactaatcctagcacataacaataatttttaaaaagttacagtaacagagacaatttgttcttggtgtggggcagagcaaatagactgatggagcaaacagctcagaaagagtcagacatatatgggaaagttgctttgtggtagaggtgacatttttgatcaatggaaaaaggaaaggctattcaattaataatatgaagtcaattgttatttatatggatataaagtgaaattgaattcctgcttgacaatataaccaaaaactattctaggtcaatttaaaacaaaaattaaaaaacacattcaatattttagaaggagatatagagaaatttttcatggctttagggttgggaaggattcctgatgcaaaacacaataagcacaaaatctaataagaaagattggtgatttcaattctattacaattaaaaacttgt

SEQ ID NO: 43373 - DNA, 472 bp, Homo sapiens
gagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaaacaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatgatgggaattcgggaaaatgaccagttaaaccagctactcaaggctgctcaccat

SEQ ID NO: 43374 - DNA, 411 bp, Homo sapiens
  misc_feature 2, 9, 11, 15, 110: n = A,T,C or G
gntcccatngnctgntctgattaagacggttgaaactagagatggacaggttatcaacgaaacttctcagcatcacgatgaccttgaataaaaaattgcacacactcagngcagcaaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggttctgcttcaataaatctttggaaaac

SEQ ID NO: 43375 - DNA, 457 bp, Homo sapiens
gtccggcgtggccattttcgttggtggtgttcagttgtggcggttgctggtcagtaacagccaagacgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatattttatttgacttgtagtaactgccaccaataaagcagtcttta

SEQ ID NO: 43376 - DNA, 287 bp, Homo sapiens
gataaacagggtgacatccaactgttacttgcctcaacttgcctttggggatcaagaaggaagttcccccgggtgggtggtagaactggaagtagtgtcacaggccatgggctcttttgcatttctcttactgtctctcacttggcctgaatgatttatcacgcgatcagttgcaactgccaaagtttgggagcactacattgatgtgaagttctggagacaaaaaggaacacaaacagataaaggtagagaagacaaaagggtgaaagagagggctaacgactggg

SEQ ID NO: 43377 - DNA, 433 bp, Homo sapiens
acagaccgtgtgtttccaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaac

SEQ ID NO: 43378 - DNA, 230 bp, Homo sapiens
gactctagccatggtaacttaattatatatttaaaaataacatagagaatgtaattggattgtttgtaacttaaaggataaatgcttgaggagatggacacctcattcttcatgatgtgcttatttaacattgcatgtctgtatcaaaacatctaatgtaccccataaatatatacacctactatgtacctacacaaattttttaacataattaaaaattaaaaatacgt

SEQ ID NO: 43379 - DNA, 466 bp, Homo sapiens
  misc_feature 23: n = A,T,C or G
attcttcttaacctaacaagaancaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagag

SEQ ID NO: 43380 - DNA, 176 bp, Homo sapiens
  misc_feature 99, 171, 176: n = A,T,C or G
cagggcaaggaagtgttatggtgcttacttcattgttttttgttgttgttgttttttgtttttttttgtatagagacgtagtctcactctgtcacccangcggagcttgcagtgagccgagatcgcgccactgcactgcagcctgggcgacagagcaagactccgtctcanaaaan

SEQ ID NO: 43381 - DNA, 420 bp, Homo sapiens
gcacttgttctgccccagacctggaattggccaattctccgaggggctctggttccttttaatgggaatggtattaagaaattacaacatgagtcctgtgggtactaattgctaatgtataagtcatgactctatgataattcagtagacatagcttttttgaaagatgaaattcatgtttgtttatacggatacttacagttcaaattcaggattacatggtttttactgaacttcaattttacatttatatctcttttttccctcatggcacaggataacaacactataatattacataataactcaattgctttatctcataatacatccatagcagtctcatgatagcagtagcaccaccaatatgattcctaaaagtagtcttttacttttttagctagttcttttttttattta

SEQ ID NO: 43382 - DNA, 472 bp, Homo sapiens
  misc_feature 7: n = A,T,C or G
atattcngctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgtttgtgagttgctcagtagtaaaaactggcccttacctgacagagccctggctttgacctgctcagccctgtgtgttaatcctctagtagccaattaactactctggggtggcaggttccagagaatgcagtagaccttttgc

SEQ ID NO: 43383 - DNA, 376 bp, Homo sapiens
cggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtg

SEQ ID NO: 43384 - DNA, 361 bp, Homo sapiens
  misc_feature 19, 63, 108, 360: n = A,T,C or G
gtaattaaagctgtacagnactaacataagaatagatatatagattaatgaaatagaatttanagtccagtggggggaaaaactcatatattcatgataaattgattntgacaagggcaccaagacaattcaagtgagaaacaatagtctcttcaaaaaatggagataggacaactggaaatttacatgccaaaaaataatgttgaatgcctacgtgacataacatacaaaaattaactaaaagtgatcaatgacacaaatgcaacagctaaaactatcaaatccttaaaagaaaacatattcctgagcttgtattaggcaatggactattagatatcacactaaaagcacaaactgcgna

SEQ ID NO: 43385 - DNA, 171 bp, Homo sapiens
catctctataaaaaataaaaaaattagccagccatggtggcatgtgcctatagtcccagctactcaagaagctgaggcaagagaatcgattgagtccgggaggtcaaggctacagggacccatgattacaccactgcactccagcctgggtgacagagtgacaccctgtct

SEQ ID NO: 43386 - DNA, 454 bp, Homo sapiens
ataagacggggattacaatggagaaagagtaattcacgcagagccggctttgcagaatttcctgaaaagatacaaaggcccttctgaccattggattggccttagaagagaatcatcccatcgcatttggaaatggacagacaacatggaatataacatgcttgctatcagaggaggtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcatcagcagcttccaccatgcccctggaaaaactgcaagtaacagacctgcacatgtatcccctacatctaaaataaaagttggaaaaagtga

SEQ ID NO: 43387 - DNA, 398 bp, Homo sapiens
  misc_feature 330, 392: n = A,T,C or G
ctagaagggaggacttgaaatgttcctaaaacatagacatgataaatacatcaggtaataggtacccccaaataaccctgacttgatcattacacattttatgcatgtgtattaataaaaatagcccctgtaccccataaatatgtaagatattatgtatcaataaaaagtactcagggctgggcacggtagctcacacctgtaatcccagcactttgggaggctgaggcgggcagaatacctgaggtcgggagttcgagaccagtctggccaacatggtgaaaccctatctctactaaaaatacaaaaaaattatctggtttggtgggngtgtgcctgtagtcccagctactcaggaggttgaggcagggggaattgcttgaaccaggaangtggga

SEQ ID NO: 43388 - DNA, 156 bp, Homo sapiens
  misc_feature 28, 33: n = A,T,C or G
aataaaaagaaattttgcctgccttttngaatntcttttgaagctttctgttgatgttaactgagctactagagatattcttatttcactaaatgtaaaatttggagtaaatatatatgtcaatatttagtaaagcttttcttttttaatttccag

SEQ ID NO: 43389 - DNA, 202 bp, Homo sapiens
aagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagca

SEQ ID NO: 43390 - DNA, 461 bp, Homo sapiens
  misc_feature 125, 252, 457: n = A,T,C or G
aagcggctcgaggctggaagaggatcctgggcgccgccaggttctgtggacaatcacaatgggaatccaaggagggtctgtcctgttcgggctgctgctcgtcctggctgtcttctgccattcangtcatagcctgcagtgctacaactgtcctaacccaactgctgactgcaaaacagccgtcaattgttcatctgattttgatgcgtgtctcattaccaaagctgggttacaagtgtataacaagtgttnggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccangaga

SEQ ID NO: 43391 - DNA, 252 bp, Homo sapiens
aagtacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatac

SEQ ID NO: 43392 - DNA, 473 bp, Homo sapiens
  misc_feature 44: n = A,T,C or G
gagagagaataggtacttgaatataaaatattagttcacctttnaaatcaatccagtgtgaaatattggttgcctgagaggtcagtcatacagaattgtgtgctttattatttgaaatgttatttgttttcagcctggtgcagaaatccttttccttcagttatattttagaaccactgtgtgagtacattactttttaggttttgggcctcatggacattcttagcaacttgttttcacagccctttctttgatgttcatttgaaccatagcgttgttgatattcagagtattttgacctacaaacataaacattttatatggttcaaactaacagttaatttgcttcagtttaccaggcatggatgagtacagtttcaatgctaatagcaaatattttacttattttactttcctgagcactttacatgttttcactgttttcctcctcacatcaacaaccccaatgaatt

SEQ ID NO: 43393 - DNA, 465 bp, Homo sapiens
  misc_feature 3: n = A,T,C or G
agnattcaatgctattaccattaaactaccattgacattcttcacagaattagaaaaaactattttaaaattaatatggaaccaagaaagaacctgaatagccaagacaatcctaagcaaaaagaacaaagcttgaggcatcaagctgtctgacttcaaactatattacaaggctacagtaatcaaaacagcacggtacttgtataagcacagatacatagactaatggaacagaatagataatccagaaataagaccacacacctgcaacatctgacctttgacaaacctgacaaaaacaagcaatggggaaaaattccctatttagtaaatggtgctggaagaactggctagccatatgcaaaatattgaaactggaccccttctttacaccttatacaaaaattaactcaagatggattaaagacttaaatgtaaaacccaaaactataaaaaccttagaag

SEQ ID NO: 43394 - DNA, 426 bp, Homo sapiens
  misc_feature 31: n = A,T,C or G
ctagctgaatgtatggcagcctttctttatnaacctaacccataagcctgctgcatttaaggtcttaatgcaatttgagaatatttctagtagtagaatagtacaaaagctaagatttgttttattccttttctttgtgttatagataactttgaatttaattttatctggagaggaaaaggtgaaaatcaaatttcccaccaaaaggaactagtattcctttgagaagggccagctaagcttgggggcagcaaatgtacaggattggtcttagacatattttactggagagcagggcagcagtggtgtcccagaacagccttttatcagagataaaaacttcattacttcataatgatactcccaaaaagcttattggtcatttttgggagtttgctcaggtatgaactcagtcttccaaaagtt

SEQ ID NO: 43395 - DNA, 137 bp, Homo sapiens
  misc_feature 20, 43, 111: n = A,T,C or G
catttcctcctttacctttnagtgcagtttcttttcacattangctgttggttcaaacttttgggagcacggactgtcagttctctgggaagtggtcagcgcatcctgcanggcttctcctcctctgtcttttggag

SEQ ID NO: 43396 - DNA, 363 bp, Homo sapiens
aagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgac

SEQ ID NO: 43397 - DNA, 471 bp, Homo sapiens
  misc_feature 451: n = A,T,C or G
aagatggagtaagcgcacttcactctgtctctcccactgaatgcagctaaaaacctgggcaaaattcttggagtggctatttgaggactctgaaaagtaaattgtaggagacagactggggaagaagaccaaaattcaaagtaccattgaaccagcagtgggtttaccatttttttcttccagtataccccagcctgaacttaatgtatcctgcaacttggaagtgagcattgacatggacagaaaatgcgtcgagagaagtcttctagttctgactcaaggaggaggaaaggggtctcctaatgcccagagaaagcatggaaatcctacatctttctctctttttttcttttctttattctcttatacccgggcctcaaacagtccttgacagtggctgcagtggcctcaatgggggcaggcaagagcctaaaatagaggggagaggatncttcttctcagatgggagga

SEQ ID NO: 43398 - DNA, 472 bp, Homo sapiens
  misc_feature 226: n = A,T,C or G
gtttttaaagtattaattttaaaaaacctgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctangttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgta

SEQ ID NO: 43399 - DNA, 384 bp, Homo sapiens
ctgttatctacttcaggaatagaaaggacactctggacttcagccaagaggattcctgagctgaagtgcagatgacgcattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgttcttggcctgaagccccacagctttgatggcagtgcctcatcttcaacttttgtgctcccctttgcctaaaccctatggcctcctgtgcatctgtactcaccctgtaccacaaacacattacattattaaatgtttctcaaagatggagtt

SEQ ID NO: 43400 - DNA, 132 bp, Homo sapiens
gaaagaggagtattttgtcccattttccccttcctcattatcaaacagccccagtcttccttgtctctgctaagaaagtagaggcatgatgatctgcctctcaactgccctaagtcctagctaagtatcagg

SEQ ID NO: 43401 - DNA, 305 bp, Homo sapiens
atttgaaattgctaccaaactctttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttc

SEQ ID NO: 43402 - DNA, 420 bp, Homo sapiens
  misc_feature 80, 122, 126, 166, 182, 184, 222, 268: n = A,T,C or G
gctctcccaacatggcggcctcagcaaaaaagaagaataagaaggggaagactatctccctaacagactttctggctgangatgggggtactggtggaggaagcacctatgtttccaaaccngtcngctgggctgatgataacggatgacctggaaggagatgttncgaccacttggcacantnacgatgacgatgtgtatagggcgcctacaattgaccgnaccatccttcccactgctccacgggctgctcgggaacccaatatcnaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttg

SEQ ID NO: 43403 - DNA, 472 bp, Homo sapiens
  misc_feature 369: n = A,T,C or G
attcctgattgactgtccggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgggaagctcgctttccggactgggaagttactaaagggtggagagcccgacttgcagactgtgggtaaagatggtcctcaatgactggcagaggggccggattcctttctttgtcaagccacccaatgtagagccacttgtggccccccagcttctaccctcctcatctttggnaagttgtcccagaagcagcccagaacaatccaggggaaggaagtcacagaaactgcaggtgaagggtcagaatccatcattaaggaagaaacagaagagaaca

SEQ ID NO: 43404 - DNA, 414 bp, Homo sapiens
atgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgttatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagagga

SEQ ID NO: 43405 - DNA, 347 bp, Homo sapiens
atagttttctcctttagagggtcttcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttggttcatttcataaacaaactctgcatttagataactattaaaggttagttaagatgaaagatttactgtttctttgttactcgttggtacagctgtttgttttacttgcacatttgtacatatacttaatg

SEQ ID NO: 43406 - DNA, 188 bp, Homo sapiens
  misc_feature 72, 150: n = A,T,C or G
gaacccgcccggtgaaggagcctgggtgagaaacaccatccaaagctggggcaaagatgattaccttcagcntgattacaatgtattaccttcagtatgattacagaagtcctacttgacaatcacatatagaagaacggagctattcantaagttctctttcctttcccttggagggaagacagcag

SEQ ID NO: 43407 - DNA, 345 bp, Homo sapiens
  misc_feature 16: n = A,T,C or G
aaccttgtttgagagngactgggaaggtggccctaaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatattggtttttattacagatttaatcacaaatcattttttatgaatgattgagtgaaaatagtgtttataaaagggttaataaattttcttgac

SEQ ID NO: 43408 - DNA, 406 bp, Homo sapiens
  misc_feature 24: n = A,T,C or G
acatgggttgtatttttctggttncaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatg

SEQ ID NO: 43409 - DNA, 392 bp, Homo sapiens
agatggagtgaattgagatgatagaagaccttggaagccagaagaaagcattgacttcataaggcagaggtagcagggagccactgaggttttagagtaagagagggatgtgattgatatgtttaaaataatcccagcactttgggaggctgaggcgggcagaccacttgaggtcaggagttcaagactagcctggccaatgtgctaaaaccccgtctctactaaaaatacgaaaatatctgggtgtggtggcacatgcctgtagccccaactactcaggaggctgaggcaggagaatcacttgaacgcttgaacccaggaggcagaggttgcagtgagccaagattgcgccactgcactccagcctgggtgacagagcgacactcagtttc

SEQ ID NO: 43410 - DNA, 123 bp, Homo sapiens
  misc_feature 24: n = A,T,C or G
caggcgtggcttcttcagtggacnagctgcaatgcagtattgacttgacagagcctctacttctgtctcaaaatggctccaaatgatttctgtactgcaaaataaagccaaattctggaaact

SEQ ID NO: 43411 - DNA, 411 bp, Homo sapiens
  misc_feature 6, 166: n = A,T,C or G
accctnaccctcaactcaaaacttcttggagggaacatatctttttttcagagcctctgtgtgctgggttactgtatacttcccttgacagtagcaatgctgatttgccggctggtacttttggctgatccagggcctgtaaacttcatggttcggctttttgtgngtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaat

SEQ ID NO: 43412 - DNA, 413 bp, Homo sapiens
  misc_feature 24: n = A,T,C or G
aggaacataaaacttaaaaagacnaaaataatagaaagaaatttgtgggctacaaaacattttaaattattccaaaatacatttttcactttgtgttttctatttaaaacaataattcttaatgtatagtttggtattgtaaccaaattgattattaaaaatgaagaaaataaagagcataaattggaatatttaagcacggtggcttacgcctgtaatcccagcactttgggaggccaaggtgggtggatcacctgagttcaggagttcgagaccagcctggccaacgtggtgaaaccccgtctctaccaaaaatacaaaaactagccaggtgtggtgggcaggctcctgtaatcccagctactcaggaggctgaggcaggagaatcacttgaactcggaggtgggaagttg

SEQ ID NO: 43413 - DNA, 163 bp, Homo sapiens
  misc_feature 11, 26, 27, 37, 54: n = A,T,C or G
actgagacaantctcaaaagtaaaanntgtaatgacnaactacactacctaacncttcttgtaggaagtggttagaagaagctgatgcctcattttctacattctgtcattagctattatcactctaacgtttcagtgtatccttacagaaataaagcagcat

SEQ ID NO: 43414 - DNA, 272 bp, Homo sapiens
  misc_feature 11, 19, 35, 39, 43, 50, 51, 52, 54, 60, 74, 82, 121: n = A,T,C or G
cccggggaccncggccccnccgggccggggccccntggnaacntccgccnnncntgcccntgttttgacccccntaagctcnctgtttagacgcggtccttttacggaaaacttagaaaanttctgactaactagtgcagaactaaactgaacttaactgttttacttaactttactcttgaactgtcaatgacaaataaaaattctttttgattattttttgttttcatttaccagaataaaaactaagaattaaaagtttgattacagtc

SEQ ID NO: 43415 - DNA, 472 bp, Homo sapiens
  misc_feature 22: n = A,T,C or G
gacgctaacgacgatttaaatnagttgctccactatactgcataagcagtttagaatcttaagcagatgcaaaaagaataaagcaaatgggaggaaaaaaaaggccgataaagtttctggctacaatacaagagacatatcattaccatctgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggctt

SEQ ID NO: 43416 - DNA, 139 bp, Homo sapiens
  misc_feature 32: n = A,T,C or G
agtgtagtttgttgtttaaaataatgtaatcntcaaaatgatgcatattgttacactactattaactaggcttcagtatatcagtgtttatttcattgtgttaaatgtatacttgtaaataaaatagctgcaaacctcg

SEQ ID NO: 43417 - DNA, 471 bp, Homo sapiens
  misc_feature 465: n = A,T,C or G
aggagaggaggttatgatgtggaaaatgaagagaaagtgaagttgggcatgactaattcccactgagagagacttgtgctcaaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgccggttaaattccatatgctccaggatctttgactgaaaaaaaaaagaagaagaagaaggagagcaagaaggaaagattttgngaacct

SEQ ID NO: 43418 - DNA, 486 bp, Homo sapiens
  misc_feature 22, 32: n = A,T,C or G
caagcgacctgtagagcgaganttcctatatntaaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggaggggagaggggcattctcaactctgcctggacaggctgcagctggaggctattcataaggtacgtttcagcccaaacctggactcctatggatggctggtatctggggggggcaagtcagggctggttcgaatccattttgtccgtggactcgcctccccactgggccaccgtatgcagcttgaaagccgagcccacttcaatgctatgttccaaccatcctcccccactagacggcctggcttctctccaaccagcca

SEQ ID NO: 43419 - DNA, 471 bp, Homo sapiens
  misc_feature 419: n = A,T,C or G
attgcaaatctttgctctcaacatggattttggaagtatattttatatgtgccatatgttttctgcatattagccagttgttggtgtattaaaagtaaggttaaaaaactcaacctgtttttaggtttattgtatatattaaattacttttcacatatttgattgttttaataactctatagcatttttaacaggaataagtagctaccgtagggaatttggaaaatatataaaagtgtaaattaaatgaaaatatgaggtattcacatttcctgccaatacacgtaatcgtatcattgcatgtcccttttgttccttttctctatacaagaaaaatatattggccatgcacggtggctcacacctgtaatcccagtgctttgggaggccaaggcgggtagatcacttaaggttaagantttggagaccagcctggccaacatggggaaatatcatctctaccaaaaatac

SEQ ID NO: 43420 - DNA, 417 bp, Homo sapiens
  misc_feature 58, 382, 416: n = A,T,C or G
acctcacagggcgccacccttgacgcttgcagcttcggagtcacgggtttgaaacttnaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgttcgcagtcttgtgcacagagtaaacttttctagctgcccctttctgtaatagtgaaagttggtatttaacatttattcatttttaaaatatttggggaaggnctgagcttgtgaaaagaaagtgggttggtctgang

SEQ ID NO: 43421 - DNA, 216 bp, Homo sapiens
  misc_feature 2, 10: n = A,T,C or G
gngagagtgngagcaagagggagagtgtgtgagagagagttagttcaagccaaaatggccgacagagtctctcctggtttctgaatatttaaaatacaaaaaaacagatagacaaaaagaattcattttttggaccttttttcatttccatttctaccttgtatgcctcaatttgctggatttaagcactgctgcactttatgagagagaaggagc

SEQ ID NO: 43422 - DNA, 462 bp, Homo sapiens
acccttactatcttggaaggcatattaacaaacagagcttttttaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatcttt

SEQ ID NO: 43423 - DNA, 329 bp, Homo sapiens
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggagga

SEQ ID NO: 43424 - DNA, 429 bp, Homo sapiens
attcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataaggatcagactctgc

SEQ ID NO: 43425 - DNA, 455 bp, Homo sapiens
gatatttgagggaggtctggaagggtagtccaggagatagattgttcgggaaggtgcctttttgcagatgtgcggggtggaattgataaggagctggttttgcgttgactataagcggaaatcaacttcagggctttcacagcaggtatgtatagtttgtgtataaactacagtcatcccttagtatcagtgaaggattgattctatgacctcccacagatactaaaatctacgaatgctcaagtccctgatacaaatggcataatatttgtacataatctatgcacatcctcccatatactgtcatctctagattatttgtaatacctaatacaatgtaaatgctatgtaaatagctgttctactgtgttgtttagggcatcatgacaagaagaaagtctgtacatgtacagtacagatgcaaatttttttcaaatatttttaatcctaaggtg

SEQ ID NO: 43426 - DNA, 296 bp, Homo sapiens
ctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgac

SEQ ID NO: 43427 - DNA, 472 bp, Homo sapiens
  misc_feature 471: n = A,T,C or G
aaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttatttanc

SEQ ID NO: 43428 - DNA, 435 bp, Homo sapiens
  misc_feature 388: n = A,T,C or G
atcgacaagcagtttctgttttctaaaggacaaaatacagagtgtgtgtcactttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataatttttgnagggaaaaatatgcatctattttttcttgacttcttttatatagaat

SEQ ID NO: 43429 - DNA, 128 bp, Homo sapiens
gaaaacacttagtatgcagttgataagaggaatttggtataattatggtgggtgattattttttatactgtatgtgccaaagctttactactgtggaaagacaactgttttaataaaagatttacatt

SEQ ID NO: 43430 - DNA, 419 bp, Homo sapiens
  misc_feature 19: n = A,T,C or G
ctatgagaaaacgtgtttnagcatagaatttcgggatggccaaagatcttaaaagccctctagagctaactcctagctgatgtgggaacacttttaacagtatccctgaaaggtgattcttgagttttggtcaagcaccttttgtgacaggaagtttattttgtctcatgatgtatgtactcagtaaaaatttgatgtataaacatatggatagagtgtggcaatatctttattacatctaactctactagagaattcatccttatatctaattgataactgcctccctgtaattcctactttcattccctttaaaatagttttaaaaattataagctgttttacaaacaacaggaatatacaaagaataattaaacacttgtccatgtgttgaatatctaaatgtttagaaacatatt

SEQ ID NO: 43431 - DNA, 466 bp, Homo sapiens
  misc_feature 29: n = A,T,C or G
atggatgaggagactggcaacctgaaaangctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcc

SEQ ID NO: 43432 - DNA, 471 bp, Homo sapiens
aagaaaacagtattgttttttaataaataaaaatgttatcttaaaatcaacgcattagttctgtactctgaggctaacacctgttctatgtgccagctattcaaatcagaaaggcatttaacatgcttcttagattaccacctctccctgctttttcctcttccagaccagatatggctagtttcttaaatcgattctcatgatactttccagacctcttaccattgcatctcccttattaaaatgcacccagcattgttcacattcctcctacactaacagcagagtattctagatacggtctggcaagtatgacatacagagccccattaccttcctttattttgatgctgctctcttattcatggagttaaaagttgcattagctttcctggcagccatcacattttcctttcacattgtatttccatccaaacaaaaatcttgggtttttcttttgatctagtattt

SEQ ID NO: 43433 - DNA, 471 bp, Homo sapiens
  misc_feature 12, 18, 20, 21, 25, 39, 45, 47, 53, 83, 93, 95, 312: n = A,T,C or G
aactcagcttgntaggananncctnagtgaggccctgcngatgcnangaatgngggaagagcttcagtcgcagggaccacctngtcaggcatnanagaacacacactggggagaaaccattcacgtgccctacctgtggaaaaagcttcagcagaggatatcacttaattaggcatcagaggacccactcagaaaagacctcctagcgaggtccccatgtgaggagatctggctttcagccctcacctaagggaggtgaggaagaggaaaagccctcttgtcagcctgggaagaccttttcgagggagcctncctgacctgctcagatctgacattacctcttcctgcaactaaacacgagcctgggcagaacctctcagccttcctctacgccttggggggatgtttcatccaaagtacaacctgaattgaggcttctccttcactggagtgcacctgcctctacctcat

SEQ ID NO: 43434 - DNA, 103 bp, Homo sapiens
aacttgagttgtaatatattttggggaatcagctcactacaaattgtgactgtaaacattgtactgtaaatgttttgtagttttcccccaataaaatttttga

SEQ ID NO: 43435 - DNA, 462 bp, Homo sapiens
  misc_feature 8: n = A,T,C or G
agctttcngaggtttttaactgaagactctatgctctgtagttctttccacaaagagctgactgatatttgaagaagtgttttcatctatccaagaaaaatatgatgtctccatcccaagcctcactcttattcttaaatgtatgtatttttatttgtggagaagctgtacaaggtaactgtgtacatcattctacggactcttcagtagttaacattgtagaagatggatctaatgcaaaagatgaaagtaaaagtaatgatactgtttgtaaggaagactgtgaggaatcatgtgatgttaaaactaaaattacacgagaagaaaaacatttcatgtgtagaaatttgcaaaattctattgtttcctacacaagaagtaccaaaaaactactaaggaatatgatggatgagcaacaagcttccttggattatttatctaatcaggttaacgagctcatga

SEQ ID NO: 43436 - DNA, 348 bp, Homo sapiens
  misc_feature 244, 348: n = A,T,C or G
gttcttccctttgtatgagggattttgagccaagttctgtaaaacatcacaaatttggacaacatggacagagaaggccaattctcaaatcagatatgatttactaaagaagatcaggataattaaatgattctttttgaaaaacaaatcatcacagtctccaaactatcctttgtgcaaatagaaattttcactatatcaggtcctctgatatgacagctgctgatttgggacattgttaccnagaagtgaaaaccaggaacaccaatgctatgttataacctcaaacttgtaattaaacatctgggacctgcctgctttaatgaagagatagaatattttggggtn

SEQ ID NO: 43437 - DNA, 468 bp, Homo sapiens
  misc_feature 408: n = A,T,C or G
gagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgccgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtgggagcatgttnccgctgtccttggacagagccatgcggctggtgaaagatgtcttcatttctgcggctgag

SEQ ID NO: 43438 - DNA, 472 bp, Homo sapiens
  misc_feature 3: n = A,T,C or G
atncaatgattaagaaacacagttttaaaaaattgtttaaaggcatctgtcaaagaatatttcggtaaacatctggtcagtcagcgacccagggcattcagaactaggggtcagtgtcacaactactggcagcatagttgaattttgcagacttatgttagtcattgtaattttaaatatcacatattaggttcacctggattcccaactctgctggtcctaatttgactgccaacagtcatttatcaattgtaagagtgggaggaagtctaccaacttagatttctagctgagacacaggggaaacccattatcagtgccagtaaaaaggcagcgactggtaacaatagtgctttgatcatggacactccactgcactagcatatattagagaaaatgattaaatctcccatcatctcttgctggagtaggaatagtcactgctacagaacattgccatgggatccgatgt

SEQ ID NO: 43439 - DNA, 375 bp, Homo sapiens
  misc_feature 326, 333: n = A,T,C or G
acatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcgctttgggaggcccgggttgagaaggactgcttgagtgntggggantttcaaggaccagactgggcaatagggcgagacccatttcta

SEQ ID NO: 43440 - DNA, 436 bp, Homo sapiens
gataccaagtacccagttttattccaagaatattgcagtgtaccaaaggtaagtctcctttctaactcggtcttgtatggtcatggactgtttcctctgtggccagtagtactggaagccccatggaagtgctatttcatgctttagtatgtctaaaagagaccttgtgttttatcttgaattttgttgaatgaaaatttggactgttatgttaccagacttaggatagatgatagcaagaaggaaagggaacacattgattccatccagagttcaatgacctgaacagtattctgttatcactaggctgggagataatttccactagttattcccagaagtgctagaattgctgctgtttttcacttaatcagtaattactggtttctctctcttggctaattctgttcctaggtagtatttttaaaaaaaatac

SEQ ID NO: 43441 - DNA, 372 bp, Homo sapiens
acagatgatcttctcccacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaat

SEQ ID NO: 43442 - DNA, 337 bp, Homo sapiens
  misc_feature 307: n = A,T,C or G
caaggcaatggggaagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttntttagaacccgggtttgaagagcaaaaaag

SEQ ID NO: 43443 - DNA, 440 bp, Homo sapiens
ctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcaga

SEQ ID NO: 43444 - DNA, 227 bp, Homo sapiens
  misc_feature 224: n = A,T,C or G
gttataaaacatgggaatgcaaaaatattcacaaagcacatagaatgaggagattgggatgacaaattttctcatcttatttgggagcaggagatatatctaaacattaagaaatagaggttttagtgtattatgtaaaatttgaaagaaaattcttaaaaagcactaaaaagaaaggggatgccagagtcttgaagaaaacagtaaagacttagagtccgcanagc

SEQ ID NO: 43445 - DNA, 222 bp, Homo sapiens
  misc_feature 19: n = A,T,C or G
acccccgattgttactacngtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttg

SEQ ID NO: 43446 - DNA, 472 bp, Homo sapiens
  misc_feature 54: n = A,T,C or G
atagtaaagatacctctttacggactccacttatgactccctaaagcccatgtngaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatcataatcctctctcaaggacttcaaactctactcccactaatagcttttttgatgactt

SEQ ID NO: 43447 - DNA, 473 bp, Homo sapiens
ataagagtaagggcaatgggataaagctacttaatgtgtctcctccactgatcaaaaatattccatatagtcttggtgaggaattccccaggatataaatggctatttacactgtaatgaattataccatatatgatattcactcagtaatgttaataatgaactggctaataattgacaagatgcagtgcctgccagtttatgacattaacttggtttgaaactaacatatgacatagtaccagtgcagtcagagctgcccttaggcatgatgaacatgtggcccgtttttgcctggtgttttggcagcaaagcaggaagcaattttgtgtgggtcattgttctgtcaatttgtggaaaaaattacttcagtctcatataaatatagaatgggtccataaacccttcaactcatttccatggcaaaactcacttttctttttatacatgtccttcagtctcttaattttgtc

SEQ ID NO: 43448 - DNA, 162 bp, Homo sapiens
gatttaatgttatatatgcaaagtaggcaactgttttcttagttacagaagtttcaagcttcacttttgtgcagtagaaacaaaagtaggctacagtctgtgccatgttgatgtacagtttctgaaattttacaagactttgataataaaacccttaaactt

SEQ ID NO: 43449 - DNA, 341 bp, Homo sapiens
gcatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataacctagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatg

SEQ ID NO: 43450 - DNA, 447 bp, Homo sapiens
agacactgttggtgggaaagcaaacttgttcagccactatggaaagcagtttggagatttctccaagaacttaaaatagaactaccattcaatcccgcaatcccactactcgggatatacccacaggaaaagaattcattttatcaaaaagacacctgcaccaatatgttcattacagtgctattctcaccagcaaggacagagaatcaatctaagtgcccaacaacagtaaattcaatgaaaaaaaatgtggtacatagatacgatgggaaaactatgcagccatgaaacacaagaaaatcatgtccttttcagcaacatggatgcaactagaggctattatcctaagcaacctaatgcaagaacagaaaaccacatactgcatcttcccattggaaagtggcagctaaacattaaattcgcatgaaccacagatgctggagatca

SEQ ID NO: 43451 - DNA, 357 bp, Homo sapiens
  misc_feature 149: n = A,T,C or G
aacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggnggtggctgtcatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggagga

SEQ ID NO: 43452 - DNA, 113 bp, Homo sapiens
  misc_feature 99: n = A,T,C or G
cagacatttatctaccttgttttctatttatattttaagcttaaatatttattgatttatctactatcgttttgtacttaaaatacaagtatacgtggngaaactctgtctct

SEQ ID NO: 43453 - DNA, 303 bp, Homo sapiens
cgtctgcgaaatctatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattagc

SEQ ID NO: 43454 - DNA, 171 bp, Homo sapiens
attgagcagttagctcatttgagataaagtcaatgccaaacactagctctgtattaatccccatcattactggtaaagcctcatttgaatgtgtgaattcaatacaggctatgtaaaatttttactaatgtcattattttgaaaaaataaatttaaaaatacattcaaaat

SEQ ID NO: 43455 - DNA, 308 bp, Homo sapiens
gagtgacggtggcgtttccttggggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaaga

SEQ ID NO: 43456 - DNA, 379 bp, Homo sapiens
  misc_feature 4, 23: n = A,T,C or G
gatnagcaaaaaatatacagagnatccctgatcttaagaaagggggacaaacaatgaacaataagcataagaaataagtaaattacatagtaactttgaagatggcaaattttatgggaaaaaaggctcagcagagtaaaggggatcaggattactatctgcagcaggatgagcaggtcctactactaaagtcagagatcagagtaggcctcattgagaaagtacaatttgaaaaaaattaaaatgtgtgaatccacatttggtgatttgagaaactgaaattcaaattcaaacccagtaattggcctagtgggtaaattaggacatacagttatttctacttccagtattgctgtctttcagttaaaaatatgattat

SEQ ID NO: 43457 - DNA, 309 bp, Homo sapiens
gaatttggcatcttgaagtgaaaagaaacgtcgtggaaatgagtcggttgatcactgtgactgacgtacacacgagtggaatccacggcctgatgtttttgttctgtggggtttcgcgttacaggcttatatttaccgtcctgtgctaggctggaagctccctgacggcactatttcctctccgcagggcccagaatgcaacaggtctttgaggattattgaggaagttgctcaacacagaagcttcctaagtcagtctaaattgtgctttaagttattacgtagtagccaatgggcagaaatttttga

SEQ ID NO: 43458 - DNA, 344 bp, Homo sapiens
gactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagcccagctaactagcttgga

SEQ ID NO: 43459 - DNA, 362 bp, Homo sapiens
cacccagggaaattcggccttaaggccggggaactgggcttggttttccagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaaga

SEQ ID NO: 43460 - DNA, 274 bp, Homo sapiens
  misc_feature 32, 41, 72, 82, 140, 162, 164, 180, 198, 207, 227, 239, 246,263: n = A,T,C or G
tgcttatgctttaaaaaaggaaaaaaaaaaantactaaccnctgcaagctcttgtcaaattttagtttaatnggcattgctngttttttgaaactgaaattacatgagtttcattttttctttgaatttatagggtttanatttctgaaagcagcatgaatntntcacctaacatcctgncaataaattccatccgtngtttttttngttggttggttttttctttncctttaagtaanctctttnttcatcttatgggggancaattttaaaa

SEQ ID NO: 43461 - DNA, 318 bp, Homo sapiens
  misc_feature 1, 34, 178, 180, 265, 300: n = A,T,C or G
natgtaaatatgtgactaacaaaaaaaaaatgantgggccataaatactgaggaccatatttgcgtgtttccaaagtgaggggttctgcgtcctatcaaggagatgtaaactactgactacactaccgatgatgctggctttttgctccattgccttttcaagtcttcaacgtaaaanancaatcgcagttcggtttcacatgtattgttctataatccaggcaataaatgctaattagtaatgctcaaggatccgaccattcanagtaattatcataatttacttcttccttgttaaanacattccttgctgattag

SEQ ID NO: 43462 - DNA, 320 bp, Homo sapiens
  misc_feature 304: n = A,T,C or G
cgacggaaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgttngatccaacagaaatac

SEQ ID NO: 43463 - DNA, 281 bp, Homo sapiens
  misc_feature 11, 12, 17, 20, 22, 28, 34, 35, 40, 52, 57, 63, 68, 93, 114,149, 170, 183, 197, 234: n = A,T,C or G
gaggtggcggnnaagcnaangnacatgnaaatgnncacanaaccaacattgngtttncctccnaaggncccaacaccaacctctgagcccaanaccttgcctgaaaacaagcanataccgattgcttcatcctatttatggacatgtangtctagttgcattttcactgnggggagggggganggtgaattatggtnacttttaatgatctattcaggcagtagagctcttaangaaaaaaaaacccactttctctcaagcatgtatttatggggttgttc

SEQ ID NO: 43464 - DNA, 441 bp, Homo sapiens
gctctttttccggctggaacctggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcggatggcgaggatggcaagaaaagctggcaacttctatgtacctgcagaacccaaatcggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattg

SEQ ID NO: 43465 - DNA, 355 bp, Homo sapiens
gatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatg

SEQ ID NO: 43466 - DNA, 111 bp, Homo sapiens
  misc_feature 21: n = A,T,C or G
atatggggcttaaaacctagnataatgggttgataggtgcaacaaacgaccatggcacacatctacttatgtaacaaacctccacactctgcacctgtatcctggaactca

SEQ ID NO: 43467 - DNA, 194 bp, Homo sapiens
gtacatattcaggaactggagtaatgtgattccaatgagcctgtcttgaaggaactcctaggggattaacttcagctaacctgggaagttatctggagaaaccacaacagaaggactggttgtagttcgaggctgtagtcagctatgattgcaccactgcactctagcctggataatagagcaagactttgtct

SEQ ID NO: 43468 - DNA, 419 bp, Homo sapiens
atccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtg

SEQ ID NO: 43469 - DNA, 125 bp, Homo sapiens
catttcatttcagggtcttggctgcctgtgggcttccccaggtggcctggaggtgggcaaagggaagtaacagacacacgatgttgtcaaggatggttttgggactagaggctcagtggtgggag

SEQ ID NO: 43470 - DNA, 174 bp, Homo sapiens
  misc_feature 1: n = A,T,C or G
nattctaggttcctcctgtgggcacatgctagtgctgcagagcattgcccgagtgaggggcagggcttcttcataccccagctacctatcctgtgagtgcttgtcaacctcaggttccacattaaaacatcatgtgtagactcagacttagaagtgaggattagattggattag

SEQ ID NO: 43471 - DNA, 372 bp, Homo sapiens
  misc_feature 313: n = A,T,C or G
cattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttangttgaattatttttcgtttgctctttcttctacacgcgcctgatggatagtgaacctat

SEQ ID NO: 43472 - DNA, 368 bp, Homo sapiens
gatgaaggcagagtattggggtgatgcggcagaagccaaggagcactggattgccagcaaaccagcaggaggtgggagagaggcatggaacagattcttcctcacaagcttcagagggaaccaaccctacagacaccttggtcttggacttctagcctccagaactgtgagacaatacatttctgttatttaagctgctcaattggtggtacttttttacagccaccctagcaaactaacacagacttaagacagacaatggtgacatcatgaagctaagttaagagtcagacccataattctattagtttaaaaaccatatgtagatacagggaagtagaaatgggtgggtggattgacagatagac

SEQ ID NO: 43473 - DNA, 148 bp, Homo sapiens
aaattaaagaaattaagggttttatataatagacaggccccacctctcaaaatatttttagaagtctttttgtaaactaatttcttttgatcactattctgcatcagtaaaatgatttttttaaaaccaataaatcatcaattattag

SEQ ID NO: 43474 - DNA, 259 bp, Homo sapiens
gtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttc

SEQ ID NO: 43475 - DNA, 216 bp, Homo sapiens
cacaccacagtatgagtaaaggaacctaatggaatgtttttagtttaaaagaaattatctgattgtgctaagtgttcatgtgtgaaagaaatattcctccagcaccattcagcacaggataaacctcttcaaaaagcacatttaaagtatattctctgttgcatgttttagaatatggtaacttctcatgaaataaccagcgaatttccccagtga

SEQ ID NO: 43476 - DNA, 426 bp, Homo sapiens
agggaaaaaaatcctcattcccctgccttcttataatcttttaccaaaaaacacatttcactttctttacacagcttgcatgtaaaactgtttttagtagtctcaattatgtgttatagcgttaactcttagtgacttttacttttgatgaaaaccttggtaagagattttaattaggtactaggtgtggagtctaggacaatggacagaagtgcagataagggcgactgtttccagcatagcaagggggcatggctttccacatgtcccaggtcttatgtaatacacaatgatccaatgtaggtaaattgaacagttttccaaagtcaaagaagcagtttatgaccctaaactacttagaaaacctaatatctgagctgcctaatttggaccaaatgtttaaattttgaagatatctttattttg

SEQ ID NO: 43477 - DNA, 445 bp, Homo sapiens
aagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 43478 - DNA, 255 bp, Homo sapiens
  misc_feature 14: n = A,T,C or G
gagacctgaccgtngatggtagttgagggtgacttttcctgctgcctggcccttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaaggaaggttta

SEQ ID NO: 43479 - DNA, 338 bp, Homo sapiens
atatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtggcactatccttttgttggggggagcagggtataaaaatatacatacaggagattagtttaatagtaaagttttatatgtatg

SEQ ID NO: 43480 - DNA, 382 bp, Homo sapiens
  misc_feature 10: n = A,T,C or G
tctctctagnaaatgatgatgggttgtgggttttatatttgatttgttggcttttatgttgtgtcccttttttgtcttctctcccattttagtaagctttctgaaatcccactgcacctggcctggcctttatcttgaaggctctggtgaataagtgaaggatgatgaaaagaaagggacatgattatatttatgaattcatccccaatcttcccttgggaattattttctggacaaatcctaagtacttcagcgtccagttgttaggcctaattaaattgttttctccatttactgctgcctaactccatctagcagagacactggaagtgatggggcttgccatggtttgaatgtttgttccctctgaaacatgtgttga

SEQ ID NO: 43481 - DNA, 420 bp, Homo sapiens
  misc_feature 6, 31, 32: n = A,T,C or G
agcctnaaattggacattgtcattgatttcnnagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtg

SEQ ID NO: 43482 - DNA, 379 bp, Homo sapiens
  misc_feature 6: n = A,T,C or G
tcggcnctttctggccgggatatttgttggccctttgtatgtctacatttgagaaatatctattcatgtcttttgctcatttttaaattgggttatttattttcttatttgagttttttatatattttggatattaacttcttatcagatataaaatttgtaaatattttctcttgttctataggttgtctcttcactctgttgattgctttcttttctgtgcaggagctttttagtttgatgtgatcccatttgtttatttttcttttgttgcctgtgtttttggagtcatatccaaaacacactgtccagataagtgtcatcgagctttctctctgtgttttattcaagtagttttacagtttcaagttttacattt

SEQ ID NO: 43483 - DNA, 358 bp, Homo sapiens
  misc_feature 357: n = A,T,C or G
aaccactgcacgacctgctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgttctaccctcacaaaatgtacatattctgctgtctattgggaaagttcctggtacacatttttattcagttacttaaaatgatttttccattaaagtatattttgctnc

SEQ ID NO: 43484 - DNA, 316 bp, Homo sapiens
  misc_feature 44: n = A,T,C or G
atccatggcagctgaacgaattgtacgtgggcagaccgcagaanagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacat

SEQ ID NO: 43485 - DNA, 169 bp, Homo sapiens
  misc_feature 69, 71, 143: n = A,T,C or G
gtttcactccagcctgggcaaaaagagtgaaactccgtctcagaaaaaaaaaagaaaaaaaaagtgatncntccaggaccaggattaggatgaaggagataagtcagctaactgggttgtaaaatgtaaaaggcgccaaagcnctcagtaattaagtgataaataataa

SEQ ID NO: 43486 - DNA, 184 bp, Homo sapiens
  misc_feature 2, 3: n = A,T,C or G
tnnagtcgggccagacccaggactctccgactttacatctttaaatggatgagatggctaccactcagatttccaaagatgagcttgatgaactcaaagaggcctttgcaagttgatctcaacagcaacggattcatttgtgactatgaacttcatgagctcttcaaggaagctaatatgccat

SEQ ID NO: 43487 - DNA, 107 bp, Homo sapiens
  misc_feature 29: n = A,T,C or G
gaatcagggttcgattccggaaaagggancctgagaaacggctaccacatccaaggaaggcagcaggcgcgcaaattacccactcccgacccggggaggtagtgacg

SEQ ID NO: 43488 - DNA, 187 bp, Homo sapiens
  misc_feature 15: n = A,T,C or G
actgacctcagtgtngcattagggttttggtttttgtttcttttgggtatttcttttttggcacatgtgaatcttgttttgtgtaaaatgaaattactttctcttgttctctgatgatgggtttaaaattaaaagagcatccggttttggtatggggatgatccaggattatgttgtgactgataca

SEQ ID NO: 43489 - DNA, 430 bp, Homo sapiens
gagctgggggtgggggaagatgggcagccgataaaagaagtgagaccaaggcagaaaatgtgtccagaagacagccacagcctcatttagcccattctggactggggaccaccatagagaaattcaaactcctaaaactaatggataacttgcaggagattggggtgggagagggtacaaagtcaccaccgaggcttagcatctattttatactctttactcaagaaggacaaggtctgtgtagtatcagaaaggagaaggactggtatggagtgagcaaggaattggaatactggtatctgtgagcacatgcctccatgcctgaggcagaaacccttctatgccccagctggtgggcacagatgtgaataagacaagtgctgggtgacttttactttctgtgctcccatcttccaaaccagtcctctat

SEQ ID NO: 43490 - DNA, 423 bp, Homo sapiens
  misc_feature 197: n = A,T,C or G
gagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcangatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggaga

SEQ ID NO: 43491 - DNA, 414 bp, Homo sapiens
gagcagcagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataa

SEQ ID NO: 43492 - DNA, 397 bp, Homo sapiens
  misc_feature 45, 62, 162: n = A,T,C or G
gttgttaattttagcgtcttacctttttacccaaagaaaaattanaaagagaattagcatcntattctcactcatgtttctcccctggcatctttgtctgtctttgtagtgagtatggatgaaagttgactttcatttgatgctgtatgtaaagacttattntcagtagtcattaccaaatttaattccagcctcttaatatccttccactgagaagatgaaaagggtcttatatgatgttacgcctacttaaaaatgtccaagggaaaatcttcctaaaaggcaaatgtcaactgataagcctcaaaaaaataagagaaaaaatctattacacctaccattctcagagacatattggttatttagcgttcttaccattgataggttctctctggtg

SEQ ID NO: 43493 - DNA, 180 bp, Homo sapiens
  misc_feature 39: n = A,T,C or G
cctgacgtctctgctgcttggaaccgcttctagagcagnctctgcttttgccttgcttgctgccagctagactgtgacgacagcacatccaccctccacctctagcccagacacccccatttctacttataatcaagagaaaagctctaagtatctggcattgccctaggctgctttagt

SEQ ID NO: 43494 - DNA, 391 bp, Homo sapiens
cagtttgaatcgcggtgcgacgaaggagtatgtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaaga

SEQ ID NO: 43495 - DNA, 346 bp, Homo sapiens
gctgctgcataatgtgtaaatggataatgctcaaagagacaaattaccttttaataatagattgacagttatttttaagaaatgaaaaccaattttgaattgatatttgtaggcccacactgtgcctcaatgtatgaaacctcacctaaaccaggaagcctaatgacgatgcgccctttcctcttaactgtttgcagcctgcagttggcactgttcgtgatgcatggtctggttgtgccctgtgctggcatggagtcacccttagaaaatggagagagatatgttaggtgaaagggtcaaagttagaaagaagaggggaaggcatgttaggtgggtgaggaaagtg

SEQ ID NO: 43496 - DNA, 344 bp, Homo sapiens
  misc_feature 34, 60, 325: n = A,T,C or G
tagtgtctttttatttctactgtcaaatgatgtncaaaaccttttactggttgcatggcnaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctaggattatttttcactctaagtcatgtatgttnctctttgattatgcgcatg

SEQ ID NO: 43497 - DNA, 379 bp, Homo sapiens
caaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggac

SEQ ID NO: 43498 - DNA, 370 bp, Homo sapiens
  misc_feature 10, 23, 41, 47: n = A,T,C or G
gatttggcantctctagaagttnctacatgagactccaagnatggcntattgtccgtctttctatctccctacctacctatttatccatctatctgtctgcctgcctgtctatctatccgtcttcgtctcctctccccacccccaacacaaatatgacagaaatgaatacattcagattatatacatacagattcagtttcatctggtttgatttggtttggtaataatccatacactgagctaagtgctccaattttctttttcttttttctttttcgaggctagcttgttcccctgttttggaaaatttcctccttactgaaacatcacattacaaccaatattatactttgccaaatattttgttgt

SEQ ID NO: 43499 - DNA, 320 bp, Homo sapiens
atttataaaggatttgagagcccgtctgacattagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaaga

SEQ ID NO: 43500 - DNA, 468 bp, Homo sapiens
  misc_feature 7: n = A,T,C or G
agagcantgactgtgctcaccagtaaaagacaacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcatt

SEQ ID NO: 43501 - DNA, 318 bp, Homo sapiens
  misc_feature 2, 3, 26: n = A,T,C or G
annactcaactttgtgaacccctganaattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatg

SEQ ID NO: 43502 - DNA, 320 bp, Homo sapiens
  misc_feature 5, 30: n = A,T,C or G
tctancagagcctgttctgtaatcgataanccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttga

SEQ ID NO: 43503 - DNA, 109 bp, Homo sapiens
  misc_feature 76: n = A,T,C or G
gactgcaatggctgctgctaaggcacctacaaaggcagcacctaagcaaaagattgtgaagctgtgaaagtttcanctccccgagttggtggaaaacgctaaactggca

SEQ ID NO: 43504 - DNA, 127 bp, Homo sapiens
gcattttaattcatgttggtcaaagtcgaattactatctatttatcttatatcgtagatctgataaccctatctaaaagaaagtcacacgctaaatgtattcttacatagtgcttgtatcgttgcat

SEQ ID NO: 43505 - DNA, 428 bp, Homo sapiens
gtatagatctgtatgtacaggtatacacatatacatatctgtatgtataggcgaacacatatacatatctctatgtgtatatacacatctgtgtaagatgtatatatatcacatgtatacatatacaatatatctgagtgagatgtatatatatcacatatacacacatatacacatgtatatgtgacacacatacagatgtgtatatatatctgtatgtgtataatatctgtatgtatgtctgtatgtagatatatacatatatacgcatatatctgtatgtgcgtatatatacatgtgggtgagatgattcttgacctttttttgtgtgtgagagacagcttcaggggaataatttaaagactatgactccaactcttacaaagaaagtatctttgaatacactttcagtattatcattgtataga

SEQ ID NO: 43506 - DNA, 221 bp, Homo sapiens
atttggcaaactggaaataaccaaatgggagttctagaactgaaaagtacaatatctgaagttgaaatgtcatcaaatcagattaacagcagataggacacaatacgataaaagagcaataaacttcaaaacagattattagaaatcattgaaattgaagcagaggaaagaaagagatgaagtcattaataattccaatgacctgtggcatttagtggtct

SEQ ID NO: 43507 - DNA, 419 bp, Homo sapiens
  misc_feature 156: n = A,T,C or G
ctcaaacaatggatgacacaaaactatgagggtgacaaaatggtgacaggtagctgggacctaggctatcttaccatgaaggttgttttgcttattgtatatttgtgtatgtagtgtaactattttgtacaatagaggactgtaactactatttangttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttccca

SEQ ID NO: 43508 - DNA, 259 bp, Homo sapiens
agcttcattttgattacccagttaatgatcattctctcccattaaactatgaactccctgtgattaaggactgtgtttttttcaccactgaattctcagtgcttcatgcagcttttagctttcatagtatattgaatgcttgagacacttaaagaaaatccagaatggattcagagtcagagaccatgatggaaaccacatttctgccaaattagtggtcttgtgaacttgacctccctaggactctgtctgtatctga

SEQ ID NO: 43509 - DNA, 453 bp, Homo sapiens
aatctatcaccctatagaagaactaatgttagtataagtaacatgaaaacattctcctccgcataagcctgcgtcagattaaaacactgaactgacaattaacagcccaatatctacaatcaaccaacaagtcattattacccccactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaaga

SEQ ID NO: 43510 - DNA, 324 bp, Homo sapiens
  misc_feature 4, 9, 17, 29, 31, 81, 97, 107, 117, 148, 244, 310: n = A,T,C or G
actnccggntctctgtngtacgcgagcgnangaccaagcagggtgttcagactgctagagccgagcgaagcgatgcctaantcaaaggaacttgttncttcaagctnttctggcagngattctgacagtgaggttgacaaaaagttanagaggaaaaagcaagttgctccagaaaaacctgtaaagaaacaaaagacaggtgagacttcgagagccctgtcatcttctaaacagagcagcagcngcagagatgataacatgtttcagattgggaaaatgaggtacgttagtgttcgcgattttaaaggcnaagtgctaattgat

SEQ ID NO: 43511 - DNA, 477 bp, Homo sapiens
agtcttgcagctgctgaggatgttggcaaaggatgaactgatgaccatacttgagaaatgtttcaaggtttttaagtcttgttgtgaaaaccaccttggcagcacagctaagagaatagaggagttcctggcccagtttcagagcctcgatgcagaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgagcttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatga

SEQ ID NO: 43512 - DNA, 277 bp, Homo sapiens
  misc_feature 271: n = A,T,C or G
cacccagggaaattcggccttatggccggctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggncagaga

SEQ ID NO: 43513 - DNA, 417 bp, Homo sapiens
gtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagact

SEQ ID NO: 43514 - DNA, 490 bp, Homo sapiens
  misc_feature 8, 9, 36, 61: n = A,T,C or G
gaaaaacnnaataaagtaggtatgcgctgaaagtcngtggtctaattgaattcaaaacgtncttaatgggtgcgttctaagttaagacattgctgaagttgtaaataattcagaagtgatgaaattttcaggtttgggtcagtatcagcaggaaaataacttgtttccttggccttattttatagtctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggaccca

SEQ ID NO: 43515 - DNA, 456 bp, Homo sapiens
  misc_feature 7, 32: n = A,T,C or G
agattcnggcaagtccaccactactggccatntgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatga

SEQ ID NO: 43516 - DNA, 203 bp, Homo sapiens
tatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttat

SEQ ID NO: 43517 - DNA, 278 bp, Homo sapiens
  misc_feature 4, 17, 19, 38, 68, 74, 75, 81, 83, 87, 94, 98, 103, 141,143, 225, 235, 277: n = A,T,C or G
cttnttttcataaaaanancacagtttttgtatgtatntttataatttatttatttatacgtattaantttcgnncttaantncggntgataanttcngagtnttcttatcagatagtgccttctgaaatgctgaaatgtntnctatgtccatgcattgttttttctttagcatgttttttaaatggtaatgtgtgcccagaacttaaaatttcttgagacttcngtggcctaanctataatttatagttatgtgtattttattttacttattagtnt

SEQ ID NO: 43518 - DNA, 129 bp, Homo sapiens
  misc_feature 7, 24: n = A,T,C or G
aagcacntttttggggatcatagnaaggttggggttccagaaaggcatctgtgtgatggttccattgatgtgggatttccctacttgctgtattctcagtttctaataaaaagaaccaaatgaaatatg

SEQ ID NO: 43519 - DNA, 405 bp, Homo sapiens
gcttctttttcttcgcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgt

SEQ ID NO: 43520 - DNA, 207 bp, Homo sapiens
aaggaatggcatagtgaaggccctgaatgtggaaccaggtggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcg

SEQ ID NO: 43521 - DNA, 324 bp, Homo sapiens
  misc_feature 33: n = A,T,C or G
catgcagtttcctttccaaaaaaatactactgntctgggcacggtggctcacacctgtaatcccggcactctgggaggccaaggcaggaggatagcttgtgggcagcagttcaagaccagcctggtctgcaaagcaagacctcatctttacaaaaaaatttaaaaattaggtacgatggcgtgcactttagtctcagctactccagaggttgaggtgggaggatcacttgagcccgggagttcagaggctgcagtgagctatgagcatgccactgcactccagcccaggtgccacagtgagactttgtcttttaaaaaaatgac

SEQ ID NO: 43522 - DNA, 238 bp, Homo sapiens
aacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaa

SEQ ID NO: 43523 - DNA, 465 bp, Homo sapiens
  misc_feature 7, 32: n = A,T,C or G
aggcagngaacagaatctctcctaggaccctnaaaggaagtgtggctgtgcctgcagctcggttttcgactttcagcctctagagctgtgacagaataaattttctattgtttgatgccattcagtttgtggtagtttattatagcagtggtatggtttggctgtgtccccgcccaaatctcatcttgaattgtagctctcctaattcccacatgttatgggaggggcccagtgggagataattgaatcctgggtgcagtttcccctgtactgttctcatggtagtgaataagcctcaccagatctgatggttttttaagaggtttccccttttgcttggttctcattctgtcattcttcctgcggccgcgtaagacgtgcctttcactttccaccatgattgtgaggcctccccagccacgtggagctgtgagtctattaaacctctttttcattataaattac

SEQ ID NO: 43524 - DNA, 135 bp, Homo sapiens
gatttgaacttggccttagccgggtttgcaataagagtggatgttccctctagaaaagccagggctattcttgagtgggcatgtgagtggcaaaattcagggtcaagaaacaagctacctaactgggcaggcttt

SEQ ID NO: 43525 - DNA, 384 bp, Homo sapiens
gagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaaga

SEQ ID NO: 43526 - DNA, 459 bp, Homo sapiens
  misc_feature 14, 31: n = A,T,C or G
acactcactttttngagtactcaacagtctntgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgt

SEQ ID NO: 43527 - DNA, 343 bp, Homo sapiens
ggaacaaggaagaaggggttatgtgaggagggttacttgtctaagacacccttctgcatagttttggctttggggagcctgttaatgtcctacatattcaaaaataaatttaaatcaaggatggggccagacttggtggctaatgcctgtgatctcagcacttcgggagaccgaggtgggaggatcatttgagctgaggaccaaatgatcctcccgcctaagaccagtctgagctacatggtgagacccccatccctatttttttaagttatatttaatataagtatatatataatagggataggggaaaccctaaaactgagagcaacatgaaatggagaaa

SEQ ID NO: 43528 - DNA, 427 bp, Homo sapiens
  misc_feature 7: n = A,T,C or G
tgcggtngtttacgcctgtaatcccaacactttgggaggctgaggcgggcggatcacctgaggtcaggagttcaaaaccagcagggccgggatggcgggaccccatctctactgaatatacaaaaattggccaggcatggtggtgggcgcctgtggtcccggctactcgggaggctgaggcaggagagtcgcttgagcctgggatgtggaggttgcggtgagctgagattgtgccgctgcactccagcctgagcaatagagcaagactccatcacaaaacaaaacaaaacaaaacaaaacaaaaacaatattgaaaataaaaaagcacatcaccacagatcctgcagacatgaaacagtttaaatgagttcaccataaacaacttggtagtaatagctctgaatttgtagatgaaatggacaaattt

SEQ ID NO: 43529 - DNA, 291 bp, Homo sapiens
cagtcatctaagacgacatcaggactgggggcctgggtgtggggaaggttccccagaaactgcctgatagggtgcaaaggagaggaaaaatagctgctctgcacagaatgagaagctccaacacacttcttttttaaattattttttaaatagagatgggttcttgctgtgttgcccaggctgatgttgaactgctgggcttaagtgatcctcctgcctcagcctcccaaaatgctaggattacaggtgggagccaccgtgcccagcaccaacacacttctaaacagagtt

SEQ ID NO: 43530 - DNA, 378 bp, Homo sapiens
aacatagcatttacattgtctaggtattaaaagtagcttagagatgacttaaggtatacagcagagtgtatataggttatatttaaatactgagtgccagtttatatcagggacttgaacatccatggattttggtattttgtaggggagtgttctagaaccagtaccccacagataccaagggatgacagtactagtgaaaacaaacaacatcaaattttttgaatctaagatactattgattgggagataagtcagtatcttaatttattatattttatattttacatatttaaaagtatattttcatatattttctgctactgccagaaaagaatatgccatttcacttggagaaaatggtgttaaatacaaaat

SEQ ID NO: 43531 - DNA, 223 bp, Homo sapiens
  misc_feature 24: n = A,T,C or G
tgccatggcatagttgccacaagnagtaggaagaaatggacacaaatgtaggctgttttcagggcagagggaaggtgggaggaaaccagcttgctggttttcacacaccctctggggaacacccatgcacctatgagatgggtttgtgttagcatcacctctgaaagattacccacccaggcaaagaaagtgacccatatgttttcactttcttggagtggag

SEQ ID NO: 43532 - DNA, 482 bp, Homo sapiens
gaaggaagtagtttttaaatgtgagcttatatatagaaacagaatatcaacttaattatggaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattattt

SEQ ID NO: 43533 - DNA, 125 bp, Homo sapiens
  misc_feature 29: n = A,T,C or G
tgatgggtgcaccaaaatctcagaaatcnccactgaagaacttttccatgcaaccaaacactacttgttccccaaacactactgaaataaaagtttaaaaaaaatacgtaagaacagacatagag

SEQ ID NO: 43534 - DNA, 116 bp, Homo sapiens
gttttaaagtaccaccttctcctccaggaactggtcaaacataccactgatccgactgagaaggcaaatctgaaactggctcttgatgccatgaaggacttggcacaaaaaaaaat

SEQ ID NO: 43535 - DNA, 252 bp, Homo sapiens
aactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtg

SEQ ID NO: 43536 - DNA, 390 bp, Homo sapiens
gacttcaattactatgtcactttcttcattgtttataaataccaaaataagtaaaaatttactttcatcattttcttggtttcacgattgagaaccatctccaatacaaatacatcgcccgcagtgggttgctcaggtgtttcttcctcctcctcctcctcctcctcttcttcctcttcctcctcatcatcttcattctctccaagcatggaagcaaagaccttgtgaactgacttcctcactccatctgatgtttctcctgagaaaagagacattgatgggggaggggtggggaagctgcagaattctcagtgaaaaacaagtattttctaagtataaatttttaccccagtaacaccaaatttgaaagtaaaaaatagcaaatgaaca

SEQ ID NO: 43537 - DNA, 120 bp, Homo sapiens
atacaaactggtattctgttctggaggaaagggaggagtggaggtgggctgggccctctcttctcacctttgttttttgttggagtgtttctaataaacttggattctctaacctttaat

SEQ ID NO: 43538 - DNA, 420 bp, Homo sapiens
atgattggcttcactatttatatgtcccaaccgttgtgtcaggcataaactagggtttgagtgactttaaaacactgacttcctggagcctatattttggggactaagaagacatagaaagaggcgattaagatgcatccctctggctgggtgcggtggctcacgcctgtaatccaaacactttgggaggctgaggcgagtggatcacctgaggtcaggagttcgagaccagcctgaccaacaaggtgaaaccctgtctctactaaaaatacaaaaattagcctggcaaggtggcaggtgcctatagtcccagctactcgggaggctgagaattccttcaacccgggaggccgaggttgcgctgagctgaaatcacaccactgcactccagtctgggcaacagagcgagactccatccca

SEQ ID NO: 43539 - DNA, 463 bp, Homo sapiens
  misc_feature 4: n = A,T,C or G
catntttaatgatgattatggagccttataggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttactgatcaatgcatttcatacggatatagacctagggctctggagggtgggg

SEQ ID NO: 43540 - DNA, 424 bp, Homo sapiens
gtacacctgagagcatttctatcggtaaactgtcacttaaatggaggtgtccacatcttaattgtttctccttgacacatttctcaatccacgaagccaggagaggtagagtgaaaatcccagccatggatgaatgtactaatttgaaagccaagtgttaagtcggatgttttcccgttacactactactcagccctctcctgcggccacatcaacggatgcaagtcacagtcttaacacagcctgtgggagacaagcagtttgtgtgctcacagtatatattatagtaattagggtgacttagagcaaatactcttcagatcctatgtagtcagtgaaacaaaatggagagcgtattctgatagaaggacgtcgacggtgaatgttctggtggttgttgcctgttaagtaaactttagtgtgt

SEQ ID NO: 43541 - DNA, 443 bp, Homo sapiens
  misc_feature 33: n = A,T,C or G
aggatccttagtgagatgttctcagagctttantctgaaatgcagcagtaatggaaatgacgccaccccgaactatgctcatttagcctttaaaggtacaatccatttacttccaagagtcttgatgtagtaagatcaagagactttgttaactttgtgtacttattttccaatgtccattgacaatacaataaaacagttttttaaagtcccaatttacaaacagtacatttggttgataggtggatgagtttgagcacacttaatctttatatataagtttgattttctaactaaaactgtccatttaattgcctacttcttgagttctgtagtagatcttttggggaacagagggtttcagaaaagctttgatttgttctcttttcatgatccgtacttcaaagtggaattttccttgcttgattacacttagaggaaga

SEQ ID NO: 43542 - DNA, 464 bp, Homo sapiens
  misc_feature 33: n = A,T,C or G
aggattctctgcattagggcacaactcagtggngaagcccagtaggaccttctaaagaactcacataactgtctcataagagagccagcatctttttttttaagatggggtctgttgcctaggctggggtatagtgttgtgatcatggcttattgcggcctgaatctcttgggcacaagtgatcctcctgcctcagccttctgagtatctgggactgcaggttatgtgccaccacactcggctaattaaaaaaaaattttcttagagacagggtctctctacgttgcccaggctggtctcaaactcctgggctcaagtgatcctcctgcctcagccttccaatgccttgggcttacaggcatgagccaccatgtgcaagaaagatagcattttgacatctgccaaacaacaggttggcatggtctgtcagcaaacagtggtttgtgataactaccttgttaaat

SEQ ID NO: 43543 - DNA, 325 bp, Homo sapiens
  misc_feature 1, 2, 29, 56: n = A,T,C or G
nnatcgtgttgttggagagcgagcagtcnttgacggagctgaccagacttttccanaagtgccggacgtcgggcagcgtctatatcaccttgaagaagtatgacggtcgaaccaaacccattccaaagaaaggtactgtggagggctttgagcccgcagacaacaagtgtctgttacgagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagc

SEQ ID NO: 43544 - DNA, 322 bp, Homo sapiens
  misc_feature 58: n = A,T,C or G
cgaacagcttctgaaatgcttgaggcaaagtcccaagaacctggaacttagcccaganggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgaga

SEQ ID NO: 43545 - DNA, 377 bp, Homo sapiens
  misc_feature 32: n = A,T,C or G
actcatacgtctgtggttgtctgtggctcatntgcagcttggctgggctcagctggggttctggggtgctgtgaccttgtcttttgctactgcagtgggtcaggatggaaggaagtttggaagaagggtgtttgatccacaggcttttcagggagaaaactggaatgctctgctttaaggcactgtcttctcttcatatttaagccaacttgattatgcagatattacttctttaccagtggggctctaggatctctatacaggaagggcttaagggtgacaattatggtagaagggtatgctcaaagctgcctttgcacagcactttacataagactaagaaaacattaattaaccgtttcaaagaggggggaaga

SEQ ID NO: 43546 - DNA, 469 bp, Homo sapiens
  misc_feature 2, 6, 19, 24, 28, 59, 64, 256, 335: n = A,T,C or G
gnggcncttggaaggcggngcgtnctgngtttgtaatggagtatcatttgggctctgcngggcncatttgaagtcactgatgccagttcaatccccagatgggcaaattaactttagtcctttccatgtccagaagctgcggtgccccactcaactgtcaagagttagagcaggcaactctgcagtgcctctggacacaagccaccacagagaagatgtccctgaagagtttcctaaacaaaatgtaactcactgncctacgatgggaactctcccacttttccagtacctatctgagattccatttctgattcaggttcattactggatcatanacctcaacacacctggcttagtaatggtgaagcccaatactgctgaccctgctgctactcttaagattagggaccacatttgaagttgctgttgtgaagaggattatgacatgtagcccctggaatctgcccct

SEQ ID NO: 43547 - DNA, 472 bp, Homo sapiens
gagccaacatggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcat

SEQ ID NO: 43548 - DNA, 418 bp, Homo sapiens
  misc_feature 7: n = A,T,C or G
gtggatnaaaggtgaagttctgcaaatgggagagtgttcacagtagatagctcagattgattgaacacatttgaggaagagactcctgcatgagataccagcatttttacaaatactttttatgtacattctttattttgtcattttgtcaaccctctccccaagcacatcttctttccttttactatgtctatgtagggaaaaaaacaaaacaaaaaattgcacttacgttacactcccaaaatgtgggtaatccgtgtctttcaaaaaacatttctgttttttgttttgttttggtcagtccattgcataagtgacaagtttgggtgcttgtggcacgtatgtatgaagcgggagggggatgagaattgcctgtcccttcagtaggctgtaaaagtaatttacatgtaagtaaaaa

SEQ ID NO: 43549 - DNA, 445 bp, Homo sapiens
agagcctaatagtttcctcaaagcctagtatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactg

SEQ ID NO: 43550 - DNA, 471 bp, Homo sapiens
gaagttgcttatcagctaagaagtttttgagctgagatgatggagttttctagatataggatcatatcatctgcaaagaaagtttgacttcctgtcttcctatttgaatagcttttctttctttctcttgcctgattgccttggtgagaatttctaatactgtgttgaataggagtggtgagagagggcatctttgtcttgtgtcagttttcaagggaatgcttccaggttttcaggtactcaggcaacaaatagcgttaggaatagaatagtacctcacatctcaatgctaatgttgaacgtaaatggcctaaatgctccacttaaaagatatagaatggcaggatgggtaagaattaaccaaccaagttgctgctgtcttcaggagactcacctaacacatacggactcacataaacttaaggcaaagggttggaaaaagacacttcgtctaaatggacacatcaaaag

SEQ ID NO: 43551 - DNA, 470 bp, Homo sapiens
  misc_feature 18: n = A,T,C or G
aaactcctttccttcagnccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcat

SEQ ID NO: 43552 - DNA, 468 bp, Homo sapiens
  misc_feature 7, 18, 20, 34: n = A,T,C or G
tcacaancaaaccccagnanataaccttggctgntcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagt

SEQ ID NO: 43553 - DNA, 466 bp, Homo sapiens
ccgactgcacaatcacaatggctgactcattacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaac

SEQ ID NO: 43554 - DNA, 473 bp, Homo sapiens
aaaataaaaaaacaatctttaaggaggttcataatcactaggtgggtatattttaaaattacaattatatacctagatgtttggaaagccatgcttaaagaattggctacatcaattctacgtgaaacatgttagatatttaaatctaatattctcagatttaaatctaatatcagatttaaatctattattctcagattattttttcttcaactgtgaatccttaaacacagtatgcatttggtaaaaccaataggatctaaacaatgaattcaaaggataaactaaatccaaagatgtagttttagttctggctctttagttctagacttgggtcttcattttctcctctttaaaatggtaacactctccttttcctccgtgccccagggacatacctagagaataaagcaactgaaagcactcggagttttcacttagaatgttcaaataaaaacaatgttaggttacgc

SEQ ID NO: 43555 - DNA, 121 bp, Homo sapiens
aatgccccaactaaatactaccgtatggcccaccataattacccccatactccttacactattcctcatcacccaactaaaaatattaaacacaaactaccacctacctccctcaccaaag

SEQ ID NO: 43556 - DNA, 194 bp, Homo sapiens
gtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacga

SEQ ID NO: 43557 - DNA, 326 bp, Homo sapiens
gaccacccttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgtaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttt

SEQ ID NO: 43558 - DNA, 138 bp, Homo sapiens
atttacaaagtgaacattggagcatcagaaatttagaagaggagagaaagctgcaatcaggttgaaattggggccgtctgagcttcaattttcattgttaaaagtggagaaaggagaaagcaaataataacatcaacg

SEQ ID NO: 43559 - DNA, 150 bp, Homo sapiens
  misc_feature 9: n = A,T,C or G
cttccgagnaagctattccggtctcaacatacgccgttccaccaattttttttttagccccaccagcttcaggacttctgccaattttgaatgatatagctgcaccaacaatatcccgcctcctctaattacatatgatgttctctgttc

SEQ ID NO: 43560 - DNA, 428 bp, Homo sapiens
acttcaagggtacctgaagcgaattggcaccaaagcagcagctgtattgccgcagttctagcttcaccttcacgatgtttcccttggtcaaaagcgcactaaatcgtctccaagggacagagaattgctctgttacccaggctggagtgtagtggtgtgatcatagctcactgcatcctctaactcctggactcaagtgatcgtccggccacagcctcctgagtagctgggactacagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttagcagagttaccccaaaggaatg

SEQ ID NO: 43561 - DNA, 313 bp, Homo sapiens
  misc_feature 81, 198, 311, 313: n = A,T,C or G
attgaattttttttaaaaagtagatccaagttgatagagcttccaggcacctgagagatgcaaactcagatcatccctggnggaatatacctcaaccctggcttcaaagaattcttaaagatagattaccaacatatgtgagcttataatagtaaccaaaaaaccaaaaaaaaaatcacaaaagaaacacggttctgngaaccagcatcaacagaaacaactgaatcagacccagagaaactttaggtattggaattattgaatatagaacataaaataaatatatttaatgaaatagaaaagtaaataangn

SEQ ID NO: 43562 - DNA, 411 bp, Homo sapiens
agttagtaacctacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaagga

SEQ ID NO: 43563 - DNA, 258 bp, Homo sapiens
aagctacagggctcccactgattctacattatgttgagttgtgtaattatttaattatatattacaatgtaataataatagaaataaagtacacaataaatgtaatgcacttgaatcatcgcaaaaccatccccctccacagtccatggaaaaattgtcttccacaaaaccagtccctggtgccaaaaaggactgggaccactgcttcatagcatatgaagttgtatacctgagtatgaaataaaatttataaattac

SEQ ID NO: 43564 - DNA, 275 bp, Homo sapiens
  misc_feature 6, 150, 153, 185, 261, 268: n = A,T,C or G
catttntttacaggctcacacctgtaatcctagcaccttgggaggccgaagcgggtggattacctgagggttgggagttcaagaccagcctggccaacatggtgaaactccgtctctactaaaaaaaaaaatacaaaaaattagccaggnggnaattccagctactcaggaggctgaggcagganaatcgcttgaacccgggaggcagaggccgcagtaagccggaatcataccactgcactccagcctgggcaacagagngagactntgtccca

SEQ ID NO: 43565 - DNA, 463 bp, Homo sapiens
agtaatagcagttttaacagcattatacctacctcagcaagcaagcatttaatagaagtttttcttgtgagtgaatgaatatgctgtaagttgatattcaggtgattttagtattacatagttctctcgtaggactttggagtataggttattctgtattacttaaagcctgatgcaaatgtttttaacaatcaaccaagtggattttaaggctgtcaattttataaaaattaaatcaagaaattacaactagtatactctcttgaatatttggccatctcagtttcacgaagaagtatattaagggattttcattttctgtaacactgttacagatgagtgataaataacacaaaatactgtaacagacccgtaactgtgatttttgatgttgtatatttgcttagctggaattatcagttatctactatatgggaaagtctgttttcccaagggacataga

SEQ ID NO: 43566 - DNA, 456 bp, Homo sapiens
caccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaag

SEQ ID NO: 43567 - DNA, 464 bp, Homo sapiens
  misc_feature 1: n = A,T,C or G
ngagattgtcagtgagataagtaaaaaacttaaaaaaggaatagatttggtgcaaatgggaaaatatatcttttgaacccattatttgatttttcagtataatgcttttttctctgttcgtatatatgaagatttgattacttgatttttcagtataatgcttttttctctgtttgtatatatgaagatgtgattacttgatttttcagtataatgcttttttctatatttgtatatatgaagaccataatgatttatgcatgtggagatgggtgaagtaacgagatgtactagaatgagattagacatcttttctaggagaccagtgtgggcattgtgtgctttaatatctcttcatcagtttactttagaactaccttttccttaaaataagtaatttaataataatagactagtgaagataagaatgcatatgtttagatattgattatttgacttgaatt

SEQ ID NO: 43568 - DNA, 333 bp, Homo sapiens
aacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttaccctt

SEQ ID NO: 43569 - DNA, 156 bp, Homo sapiens
gcggtgagccgggatcgtgccattgcgctccagcctgggcaacaggagtggggctccgtctcaaaaaaaaagaaaattggactgtatatgatgccaatttttcagaagaaataaggtcagaaggagaaatgagagagtaaatatattatgcactga

SEQ ID NO: 43570 - DNA, 483 bp, Homo sapiens
  misc_feature 7: n = A,T,C or G
caccaanggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggtgagtaaagagaagtggagacagggtttcaccatcttggccaggctggtcttgaactcctgatcttgtgatccacccacctcggcctcccaaagtgctgggattacaggcttgagccacggcgcccggcccagacttaacttttaagaggagaaattcaagaatgagaatctgggagaaaaatctaatcaagacaagagttttatgtaggggccactaaatatagatgttgctccaggagctccccaggaaaagaatggagttcacagaaagagtgaccctgaggaactaagggaaccgc

SEQ ID NO: 43571 - DNA, 201 bp, Homo sapiens
  misc_feature 6: n = A,T,C or G
taggtnaaagcagttgaattatgttaaatgttgcccttgcccgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagct

SEQ ID NO: 43572 - DNA, 409 bp, Homo sapiens
agaaaacaaaaataataaaaacagaagtattggccttgacagttaattatagaaaacctcagatattaatttgcttttgatttcaaaagatgctgcagttgcatgcattcaattattttaaataatcttttctggctgagtgcagtggctcacgcctgtaatcctagcactttgggaagccgaggcgggcagatcccatgaagccaagagttcgagaacagcttggccaacatggtgaaatcccaactctactagaaatactaaaattagcccggcatggtggcaggcgcctgtaatcccagctactcaggaggctgaggcacgagaatcacttgaacctgggagttggaggttgcagcgagccaagattgcaccattgcgctccagcctgggagacagtgagactctg

SEQ ID NO: 43573 - DNA, 141 bp, Homo sapiens
  misc_feature 6, 13: n = A,T,C or G
cagtcncattttntcttcttcctggttccacagaagctttgtttcttgggcaagcagaaaaattaaattgtacctattttgtatatgtgagatgtttaaataaattgtgaaaaaaatgaaataaagcatgtttggttttcc

SEQ ID NO: 43574 - DNA, 368 bp, Homo sapiens
aggaggtgcagctcaacttctaccgttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactac

SEQ ID NO: 43575 - DNA, 341 bp, Homo sapiens
  misc_feature 9: n = A,T,C or G
aatcctganagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaaat

SEQ ID NO: 43576 - DNA, 438 bp, Homo sapiens
  misc_feature 7, 34: n = A,T,C or G
cttttantcctggcttcaccatgtcctagctgcnaccctcagtcccacccaagtcagactggtaagtgcgggccccaggcccccagtgtcctcttgtgagaattctctttgtcttctagtagctcctcgttggaatactggccattcttttaacacattggcttctgaaataagtgtagaacatgtgtgaacccactgtgtatattggggttcactgctccctagggagtttggtctacctgaggcatgtgatttgtgtagatcctcaagtaacagcccagggatgacaatcttgacttgtaagcatggccacattatcctgcagccctgactgtcctgataattgggtaccatccattctttttgttttacttaaaagcagtttatgctcagtgaagaatatttgaaaaatactgacaaatatgcaatggctttttt

SEQ ID NO: 43577 - DNA, 178 bp, Homo sapiens
  misc_feature 10: n = A,T,C or G
ggaaaagcanagcaatttgtccctggcctttttcgaggccatttttagttttctgcccccatttcccagtcctggtataaaatgaattacgggtatccctctaagtccctataaccctttttgggggtcacaggatatctttgataatctgatgacagtgtgatggatcctctacccg

SEQ ID NO: 43578 - DNA, 151 bp, Homo sapiens
  misc_feature 2, 9, 30, 31, 56: n = A,T,C or G
cncaacttnggagctgcattctctgggtcnngatttcatctttgctacttattagntgtataacttttggcaacttaacattatatgcctcagatttatcagatataccctattaaatggcaatgtgtctaccttgttaggttattgtgac

SEQ ID NO: 43579 - DNA, 474 bp, Homo sapiens
  misc_feature 32, 34: n = A,T,C or G
agtatgcgtggagcatggtacagtcttggtgncntagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatct

SEQ ID NO: 43580 - DNA, 476 bp, Homo sapiens
atgagttggggcgcccagctgccaacaccaagtattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagc

SEQ ID NO: 43581 - DNA, 489 bp, Homo sapiens
  misc_feature 25, 32, 34, 35, 156: n = A,T,C or G
aatcccatttattaaggctaccagnaaagtantnntaataaatttaaccaaggaagtaaaggttgtataggaggaaaactagaaattactgataaaattaactgaagtagacagtggaaatagacaaatgggagacatcccatgttcatggatcangaaacattaatattgttaaaatggccatattttccaataaaatctaaagattcattgcagttcatatcaaaataccaatgacattcttcatggaaatagaaaaaaaaattctaaacttcatgtgggactacaaaagagcctaaatagccaaagcaatcctgagcaaaaagaacagttggagacatcatattacctgaggtcaaaacgatactacaaagctttagtaaccaaaccagcatgatgttggtataaaaatggacacacaggctgagcaaaataatactacaaagctttagtaaccaaatcagcatggtgttggtataaaaacagaca

SEQ ID NO: 43582 - DNA, 320 bp, Homo sapiens
  misc_feature 13: n = A,T,C or G
atcagcaaccagnaaatgtacttaaattaatgaaataatgggtcactctaatagtttgaaatatactctgcagcataaggacatgtttagcctcttgttctgcccgtgagtgggggttgtagtcaccctgagtctcttagcataaagtaattctcaaggctaaatccatataaattaaataaatattattttccatgtctctttgcattatcattttagttccttcacaattctttttaagagtcaggtagttaatatagtttgggagggctagggagggctgaggataaatataagcctgtgtattgctattctcacgc

SEQ ID NO: 43583 - DNA, 369 bp, Homo sapiens
  misc_feature 5, 32: n = A,T,C or G
aagancggtgaaatttaaagtcaaggtataantaactctctgcatgaaagacatgcaaaactacctaaaggaaaccaaaattggaaatttgggatttaattttttaattttagaaaattttctttttcttgggaggccaaggtgggcagatcacttgaggtcaggagtttgagactagcctggcaacatggtgaagccccgtctctgcaagaaaaacaaaaattagctgggcatttggcgcgcgcctgtaattccagctacttgggaggctgaggcaggagaatcgcttgaaccagaaggagaggttgcagtgaaccaagatcgtgccactgcactccagcctgggagacagagtgagactccatccca

SEQ ID NO: 43584 - DNA, 490 bp, Homo sapiens
  misc_feature 14, 487: n = A,T,C or G
attttcccttattnattattgaatcatggataaaaagacattcttcttttcgttaaataagaaaaaatgctttacaattaattgaatttcagctaacaggtggatagatttctttctaaaatatatagctttgtaaaataaaaaagtttaataagttgagtttggaatttctgcagccaaagcatataagtgtctgagaggcttggtgaacataagttcatcacgaaacatttttacttcttttcaagttttccacagagagcacaattcaaaattaaaatgtataactttctgtttcaagcagtatatattgtcaggctggaaactctcaaaggccatcttacctaaaacctagacccagaataaataaggaaaaaatgcatataatccattgtttacaaatttcctaaaaatgaaagattctgaaatttaaaacttccataaatgacatcaaggtatctgcggttaatattagaaatcacaagcntac

SEQ ID NO: 43585 - DNA, 190 bp, Homo sapiens
  misc_feature 5: n = A,T,C or G
cggantcagtaataaggacacctttgaaagaatctgcctgcatttatcttgtgtttcttttttgtcagacagtacaaagaaaattaaggtttttcttcttcgctatacatataatactcagaagtgaaagctaaattaacttgtcagaatcgtggcatctcttttcctgagctgctgtatccaccttccc

SEQ ID NO: 43586 - DNA, 477 bp, Homo sapiens
  misc_feature 11: n = A,T,C or G
caggaaccagnattttattgatgatatagaagaaaaaactcctattagtaatgaagtagaaatggaatcagaggagcagattgcagaaaggaaaaggaagatggtaagttgggaagccagtagtttgggcttagtgacagctgctctgcatatggtaattgttgctgcctttacatgggcttttacattattctttgaagttagcgaatgatgtgccattgagcatttttatttggtttggtcattgccatttaaataaattccattaatcttgtatttttattggttgttcattagagatttaagaatgtatgacatttaagaaatatgaacattttagaagtaataatattttaataatgccacactgaactattaataaattttaatgccacaattactgttcagaatgtcttttattagctaaatgtatcctctcatgatttgaaatataataaaagtacaaatttaaacctt

SEQ ID NO: 43587 - DNA, 320 bp, Homo sapiens
gaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggt

SEQ ID NO: 43588 - DNA, 464 bp, Homo sapiens
  misc_feature 5, 29: n = A,T,C or G
ctccncatttggggacgctctcagctctnggcgcacggcccaggttatcttgtagcatagcaacttcggatttcactctacccggagagtttcccgcttggttgaacacattggcctcaggaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatga

SEQ ID NO: 43589 - DNA, 203 bp, Homo sapiens
agaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttac

SEQ ID NO: 43590 - DNA, 315 bp, Homo sapiens
  misc_feature 31: n = A,T,C or G
ctccggctgctttttagaataatgcaagatnaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggtttttttttt

SEQ ID NO: 43591 - DNA, 488 bp, Homo sapiens
  misc_feature 33: n = A,T,C or G
cacatcctaccagtgacatgctgctcaaactgncccggaccacaccctactacaaaaggaatcgaccccacatttgctccttctgggtgaaaggagagtgtaagagaggagaggaatgtccatacaggcatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatgg

SEQ ID NO: 43592 - DNA, 477 bp, Homo sapiens
atggggagcgtccagtggatgtagcagaaacagaggagttggagttgctactaaaaagagaggtgcctttatctgatgatgatgaaagttacacaggtttgtttcagataatctacattcatctgttcgtttgacatgatatttgatagaacattctggattcatttgtaatatacaaaatgtttgaatactttagaataatgctggctagctagaataatgcttagctaactagctaagaatgatgaagttagtaacctaggtgtttgctacatataccctgtgtgaatgaagtcataatgccattgccccatttctgttttctataaattgctgaactattcattattacttttaagcctgctgcagaacctctccccatgcagagctaccaccactgctactctgacttcttttcattctattataaattacagagctactaaccaaacacttcatgtctttttccggtgtcct

SEQ ID NO: 43593 - DNA, 317 bp, Homo sapiens
gtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattacattgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttc

SEQ ID NO: 43594 - DNA, 180 bp, Homo sapiens
  misc_feature 23: n = A,T,C or G
aaaaaaggcagcagctaccaagnaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagagac

SEQ ID NO: 43595 - DNA, 469 bp, Homo sapiens
  misc_feature 11: n = A,T,C or G
gtccggcaganagggatcttgctgtgttgctcatgctggagtgcagtggctattcacacatgtaatgatagtatactgcaactatgaactctagcaatgtttccagctcagcctcccacatagctgggactacaggtacatgtcaccatacctggtcataattattatttttaatgggaagcaatcgggagtcttcacttcttaatctgtctctgacattgttagctaatgtcaagtgacttcttccccaggtcatgttacctgtcagtactcaatcatcatgtacacagtaagaaattgttttatcttttcactctgaaatgcagggatagaaggaaggcatcaaaaaattaacaatggattatttcatcacaatgttaagtgcaaggtgtcggtacagcaagataatcctagatatttatttgaccttggaatgccgttaagcatatatctacttaaaaattgatgt

SEQ ID NO: 43596 - DNA, 150 bp, Homo sapiens
  misc_feature 7: n = A,T,C or G
gtagaanacttcaaggaaaataagtgaaattttaaaagtcagcattttcttagacctcttcagctgattgtttatttttctatgaattcctacacatggttattcccccctacttgagataatctaaatataaaccagctacttgatgtg

SEQ ID NO: 43597 - DNA, 490 bp, Homo sapiens
  misc_feature 6, 8, 33, 34: n = A,T,C or G
tgtatncncatgtagcattagagtcaccacctnnagatctaagaccttggctctatctggtgctggttctgccacacagaaaccatgtaccttgggcatgatcatctgtttcctcatctctaaaatggtgatattcctaactttcctatcacttgggcttttgcaaggatcaaatagggcagtatatagaaatggactttgtgaattgaaaattagtattctatagaagatattgataatattcagtgagtgacaacagctgctttacatcggaaattctgtgataatcagttttttgtttgttttagatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctg

SEQ ID NO: 43598 - DNA, 190 bp, Homo sapiens
aaaggtgtaagaattgatgatggaggaaggaataaacaaataggtgagtacaaatcacacctgggtgatagaattaaaagatttgccgctataagaagtttggaaatgtactatttatttatgtaattatttctccctcattcaaaatcagtcttgaattaagtctacccagatataaaaagtaagatgt

SEQ ID NO: 43599 - DNA, 341 bp, Homo sapiens
attgttaccacaaagtcttttacatttttcaaatttgtgtggatataaacagtatttttatttatatcaccatcatttctgtttcctaataaaagacctttatctccctaaggttatcaccacttatctataatttcttgtttattaattttaataaaatatacataagtgggaatgtacagtattcagtattctgtggtttacaaatgaggcaggcacatactttaaaggttacacctattaagaaatagatgctaatggcacgtctctctctgagtacgctcacactcccttttgttgggtgtgtgctttccctcttccaataaatcactgtactatca

SEQ ID NO: 43600 - DNA, 476 bp, Homo sapiens
  misc_feature 34: n = A,T,C or G
ctattccaaaattaaaatatagttaagaattttnaatttaaaaatcacagattttatttctttggtttttttaatgattgatctctgatattataattttactattaatgagctaaaacatgactaaatcccagtaaatttttaagtgttacagaaaacatacatttggtccttgtcagtattctatataaaaatcttatctgtatgtatttaaaaaaatagttgaattcaaattattggaatactgaaacatacttacatctagttttaataaattaagcatgtattcttcctctgaaattagtttatgggtttaaatttaacctgtataaatttcatttaatattcgaattctcaggggaggaatgaaaaacattatgtagatttagggatttggtttggaaactccatatcatatgataacagaagagagttaatgaacatagtaagatgagctaaactcatctacacaggtt

SEQ ID NO: 43601 - DNA, 333 bp, Homo sapiens
  misc_feature 6, 12: n = A,T,C or G
gagaanccaagnattttaaaatgaagtgtcaagtacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgacagggaaagagaaacaagtgactgagaagtcttgttaaggaatcaggttttttctacctggtaaacattctctattcttttctcaaaagattgttg

SEQ ID NO: 43602 - DNA, 280 bp, Homo sapiens
  misc_feature 33: n = A,T,C or G
gatctgctaccattgggatgataacctgagganccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagcccgcagcccgccaacagcagcgctgttagtgagctaagtaagcactgacttcgtagaaaaccataacatcggccatcttggaaaagagaaaaacaatggagttacttattt

SEQ ID NO: 43603 - DNA, 129 bp, Homo sapiens
gtatccgtggataatatattctttatatacctaaaaagtaaaagttttttcaaagagatcagttcttcagcatagaagtctggacccttggtttatgtgtaaaggagatgggtaaagattagggatgga

SEQ ID NO: 43604 - DNA, 172 bp, Homo sapiens
ctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtac

SEQ ID NO: 43605 - DNA, 211 bp, Homo sapiens
gtaacccatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttgc

SEQ ID NO: 43606 - DNA, 479 bp, Homo sapiens
ctgcagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaag

SEQ ID NO: 43607 - DNA, 177 bp, Homo sapiens
cacatgaaagactgaaaacactgacaactacaaaatgttaaaagaaattaaagaagacactgggtgtggtagctcacacctgtaatcccagcattttgggaggccaaggcgggtggatcacttgaggtcaggagttcaggaccagcctggccaacatggcaaaaccttgtcttggtg

SEQ ID NO: 43608 - DNA, 471 bp, Homo sapiens
  misc_feature 443: n = A,T,C or G
caatcaggagacccggtccaggtcgagatccaattccaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctccttgaaaatccccttttactcatggcccacagtagaatatccaaaacgccttggctttcangcctggcctttcctacagggagctcagt

SEQ ID NO: 43609 - DNA, 412 bp, Homo sapiens
tcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctacgggtggttttgatatttgtttgtttaaga

SEQ ID NO: 43610 - DNA, 129 bp, Homo sapiens
cgggcaggggggatggaaaataagtagaaacaaaaaagcagtggctaagatggtatagggactgtcataccagtgaagaataaaagggtgaagaataaaagggatatgatgacaaggttgatccacttc

SEQ ID NO: 43611 - DNA, 138 bp, Homo sapiens
  misc_feature 80, 84, 120, 135: n = A,T,C or G
ggtccaaggccatttttgctggctataagcggggtctccggaaccaaagggagcacacagctcttcttaaaattgaaggngttnacagcccgagatgaaacagaattctatttgggcaanagatgcgcttatgtntat

SEQ ID NO: 43612 - DNA, 143 bp, Homo sapiens
ggtggcgggtgcctgtaatccctgctactcgggaggctgaggcaggagaatcgtctgaacctgggaggccgaggttgcagtaagctgagatcacgccactgcattccagcctgggtgacagaggaggctccatctcaaagaag

SEQ ID NO: 43613 - DNA, 353 bp, Homo sapiens
  misc_feature 1, 12: n = A,T,C or G
nacgataaaaanaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagag

SEQ ID NO: 43614 - DNA, 464 bp, Homo sapiens
ggctgactccagtgctcgtatactcccatttctgcccatgaaggggtcagggaaatatcctgcttcaaaaggacatcatcaagaaagtgaaaggaaaaaaatgaaaagacccacagaatgggaaaagatatttttaaagtacatatgtgataagaaaattatatctagaatgtgtaaagaagtcttacaactgaataataaaaatataaatattccaataagaagggaaaataggattttaacaggcctttctctaaagaagatatgcaaatggataattagcacatgaaaaaaagctgagggtcattagtcattagggaaatgcaaatcaaaaccatagcatacccgttcatacccataacaatacctaaagtaaaagggacagatgttagtgtctgtgaggttggagggaaactggaaccctcattcgctgcttgtgggaatgtgaaatggtgcagccactt

SEQ ID NO: 43615 - DNA, 419 bp, Homo sapiens
atatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttat

SEQ ID NO: 43616 - DNA, 353 bp, Homo sapiens
cgatctccttttaatgtttttctttcgttttgcactgacagtctggtgacaggtgctgccagggtgcaagttacattgcaatgttctaaaccttttgaagtgttcttagcaaaagcctttctttctgggtgtttttgtcgaacgagtctatgaagactcaatgcatccatcttgggctgatcatgccacagatctcattccagctatagtactgccgagaagtgaagtttatcattgaattttacctgtgttgctctcttttaaagtaatgactttgagatgcatgctttgtatcatattgaaaagtatgttttattttccttaaagttgtaatattgtgtgtgaaactgtac

SEQ ID NO: 43617 - DNA, 337 bp, Homo sapiens
  misc_feature 16, 53, 57: n = A,T,C or G
cttggctcactgcaanctcgacctctcaggttcaagcgattctcctgcctcancctnctgagtagccgggattacaagtgcccgccaccaaagctacaccacccagctaatttgtgtatttttagtagagacggggtttcgccgtgttggccaggcttgtctcgaactccccacctcagatgatccacctgcctcagctgggattacaggcgtgagccgccaacccgggccaagaatgtgttttcaacatcatgtctacgttatagggcatctgtctcatgaggcctcatcattgtgtgtttctgagagctggctgattctggaggagcgtaaggga

SEQ ID NO: 43618 - DNA, 227 bp, Homo sapiens
actgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaaga

SEQ ID NO: 43619 - DNA, 116 bp, Homo sapiens
gactttgtgatttaattttttcttttttttaagtggggaggaaggggaagctagatggactaggagagacttgattttggtgctaaagttccccagttcatatgtgacatcttttt

SEQ ID NO: 43620 - DNA, 304 bp, Homo sapiens
gtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaacgtttctcactgtcttaaatagaatttttaaata

SEQ ID NO: 43621 - DNA, 378 bp, Homo sapiens
  misc_feature 15: n = A,T,C or G
actgtagagtacagnagtaacgccatgcagtggtatttaaatgttaggaaaaagtaaagttatatatggaaaactatttctgcctttgagtatttaataactccctttccccacctttccctttttggacaatattgttggtatcgacaaaactaaagtggcatgtgggttggtgattctgcaatctttgtttccacatgctctttaatttcatcatcctgaagttgttacaactataacaacagtgaaaggatgactttttttaaacttagatctgccaaaattcctcctacttttggacttttataaacttactgctttaaaaaaatggcattctgagcttttattaatatctagatattggttttactaaatcat

SEQ ID NO: 43622 - DNA, 473 bp, Homo sapiens
  misc_feature 31: n = A,T,C or G
taatgtgaaaagtgactgaaacctccacagnagaatttcctccccaatgtctctgcctatcccactgattgttctggttcctccccacataataggctcaaggaagttgccaggatttcctgtattttctctcctatgagtttcctctatttttgttgcaagctaagtgctttattctttttcttctcagatattcaaacacaattaacaaaataaacatatatccttgagtatctttctccatgccctttttggggggaagcatttttcatagaatgtgtaaccaatctaaattattgacaggctattcctctcattggactttttggcgtgacctaaatcagaacttcaatttatttagaacaattattgcagctcccttaacaaatgatctatttggttttgcttccttccccttcaatccccaaaccaggcatcaattattcgtgtttctataattgacctgagtgctg

SEQ ID NO: 43623 - DNA, 100 bp, Homo sapiens
  misc_feature 9, 40: n = A,T,C or G
atggaaaantaattcgactctaaacaccactgaaaacttntaaaaaatgtttagatacctaaatatggtggtcagcgttaataaagtggagaaatattgg

SEQ ID NO: 43624 - DNA, 112 bp, Homo sapiens
  misc_feature 37: n = A,T,C or G
tgcgtgtggcagttttaagttattagtttttaaaatnagtactttttaatggaaacaacttgaccaaaaatttgtcacagaattttgagacccattaaaaaagttaaatgag

SEQ ID NO: 43625 - DNA, 236 bp, Homo sapiens
atatatgtgcatatgaaaatacatttgcataggtacctatccatatgtatatacacacatacacacgtttttcctcataaatgaaactggattaaattttatttccaatattcaggtgactcttaaaactgaggggaaaaattggggataaaaagcaggacaaggcaataattatcctgtagcttatctcaaaatggaaatttccccaacaacattagttctaaattctaatattt

SEQ ID NO: 43626 - DNA, 459 bp, Homo sapiens
  misc_feature 47, 210, 358, 417, 420, 459: n = A,T,C or G
ggtttttttttgcagccctcaaatcctatcttcctgccccacaatgngagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggnggcggtcactccctctgccactatccccagggaaggaaaggctccgccatttgggaaagtggtttctacgtcactggacaccggttctgagcattagtttgagaactcgttcccgaatgtgctttcctccctctcccctgcccacctnaagtttaataaataaggttgtacttttcttactataaaataaatgtctgtaactgctgngcnctgctgtaaacttgttagagaaaaaaataacctgcatgn

SEQ ID NO: 43627 - DNA, 427 bp, Homo sapiens
  misc_feature 25: n = A,T,C or G
caaatgttgaagttcttcaagaatngtcctttggaggtgatgtcattgaaaatgatgagtaggaaactccaagagcgcatttctccacaaaaccagtgaatacattggcacaaattgtcagaatcaattttatataaattctggaaattagtcaaaggtttatagtaaccaaggaaacatctttttaaaaagatggctgaggctggatgctgtggcttatacctgtaatcccagcactttgagaggccaaggcgagcagagcatttgagtcaggagttagagaccagcaaaaaaattagctgggtgtgtttgcgggcacctgtaatccctcagggaggctgaggcaggagaatcgcttgaacctggaagatggaggttgcagtgagccaagatcgtgccacctcactccagcctgggcaacaagcga

SEQ ID NO: 43628 - DNA, 465 bp, Homo sapiens
gatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactg

SEQ ID NO: 43629 - DNA, 244 bp, Homo sapiens
gaggtgagtgaacaagttaaaaaatgtgcttatttagaaagatggagacgacaatactttgtcatgtggaatgctgttttatttcattgtttaaaatagaagtattaaatgtgcaataatttttattttgtctgaagatggtgataccagtgcaactgagagtggtgatgaggttcctgtggaattatatactgcatttcagcatactccaacatcaattactttaactgcttcaagagtttcc

SEQ ID NO: 43630 - DNA, 358 bp, Homo sapiens
gggaggtgggatgggtattggttaaaggggacttcagctttttatataaacatccacttctctttcaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagct

SEQ ID NO: 43631 - DNA, 324 bp, Homo sapiens
ggtaaactctgagatgtattttagtaaactattaaagatgaactgaggccagtcacagtggctcatgcctgtaattccagcctcctgagtagctgggactacaggcatgcactgtcacacctcactaattttttgaatttttgagatcctgtctcaaataagtaaataaaaagatgtgcagaattacattttgcataatatatggggagcagtaagatctagaatatgaaactgttgtcactctggaattatcaacatggtactctgactgaattaaatattctcaaatgagcagaacaaaacctggtatccaaaaacttaagc

SEQ ID NO: 43632 - DNA, 418 bp, Homo sapiens
  misc_feature 23: n = A,T,C or G
ggaacaatgtccctcctcttagnaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttg

SEQ ID NO: 43633 - DNA, 415 bp, Homo sapiens
caaacctattttttaaatattctaactttgtagctcttaagcagttttattggatttttgagaaaggtacaaccatacttacatattataaatgatagcagaaggtatttagctactagcattagaaggccgggcatggtggctcatgcctgtaatatcagcactttgggaggctgaggtgagaggatggtttgagcccaggagcttgagaccagcctggatagtatagctagaccttgtctctatttacaaaaaattaagaaaaaaattagctgagagtgatggtgcacgtctgtagtcccagctacccaggaggcttaggtgggtagatcacttgagcctgggaagcagagattgcagtgagctgagattgcaccactgcactccaggctgggtgacagagcaaaaactctgt

SEQ ID NO: 43634 - DNA, 113 bp, Homo sapiens
  misc_feature 78: n = A,T,C or G
gtaaatgatgagttattgggtgcagcacaccaatatggcacatgtatacctatgtaacaaacctgcacgttgtgcacncgtaccctagaacttaaagtgtaataaatatatat

SEQ ID NO: 43635 - DNA, 297 bp, Homo sapiens
  misc_feature 294: n = A,T,C or G
cattcagctggtctaggtgactagagactgcagagatgtcaggactgttgcctaggacacaaagcagacttacagggcattcctcactgaaagaacattttagggacacttacttatccagaaaggcataaataaggaactggtaaccctgataacttgagaaccctactgctacctggtgattagaggcaggctgaggcatgataattgcttgaatctgggaggtggaggttgcagtgagccgagatggcaccactgcactccaacatgggtgacagagcaagactgtctcanaga

SEQ ID NO: 43636 - DNA, 204 bp, Homo sapiens
  misc_feature 33, 38, 97, 100, 119, 134, 166: n = A,T,C or G
atatctgtaggggtattttacattcaaaaatgnatgtntttttttcttttcaaattaaagtctttgggactgaattgcactaagatataacctgcangcntataatacaaaaaaaaatngcagaactgttctanaacgctaataaaatttatgcagttataaaaanggcattactgcacagttttaagatgatgcagatttttt

SEQ ID NO: 43637 - DNA, 170 bp, Homo sapiens
gtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaatataaggaaagactactg

SEQ ID NO: 43638 - DNA, 469 bp, Homo sapiens
gtgaccactcatccgcatatttgctgggagaactgaggtaccatgacttggtgctgcagttgattagcctagaaatcttaagaccattccaagagcacgattttatggccctctgattcatgccatggatatgtaacatgatttctgatctgtgggagctgccagataggcctgtcccaaataaagatcgtcacaaatctttactgaatgatattattgggaagtgcacaattatggcaccctgtaaccacctccagaactttccatggtaggcatgggcccaccccattcccttaccctgaattggttcaatactgtatctggacataacaggttacttccaaccataatctgcatcgtggatagacataaggaaaaacagctttctcaaccacctacgtaataacagcaaaccactgtttcccaaactcagtgggttaaaagactcacctgaaaagctttcaaaaat

SEQ ID NO: 43639 - DNA, 261 bp, Homo sapiens
  misc_feature 33, 175, 178, 218, 219: n = A,T,C or G
atggaccgggcatttgtaattttactttcaagnatatactctggtagactgaggcgggaggatcacttgagcccaggagttggaggcttcagtgagctgtgatcacaccactgccctcagccaaacctgagtgataaagtgagaccctatctcttaaaaaaaaaatccctttgtngtngagttattttatgtcatttattggtaaatacctaacattnnagacctagtcattaccagttaacatagaatttaattggatgc

SEQ ID NO: 43640 - DNA, 206 bp, Homo sapiens
  misc_feature 31: n = A,T,C or G
gaacaaagcataatatttcgcccactaagcnaatcactttattgactcctagccgcagacctcctcattctaacctgaatcggaggacaaccagtaagctacccctttaccatcattggacaagtagcatccgtactatacttcacaacaatcctaatcctaataccaactatctccctaattgaaaacaaaatactcaaatgggc

SEQ ID NO: 43641 - DNA, 199 bp, Homo sapiens
ggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatg

SEQ ID NO: 43642 - DNA, 393 bp, Homo sapiens
  misc_feature 15, 16, 187, 379: n = A,T,C or G
agggaccgggcaaannggtgaaaataggacttttaaatatacagaagtattctagtcacccttaggaatgaaagtataacattaagcaatatttgaagatttaaggatggcagtaagcttgcctaatctttgattcataccactgtcaacacagtttttgattcatgtagagtcaaattaacaaggntggaaggatcctaatggttatcctagccaaccacatatcaagtactacctccctggtaagtggtcctgtagactattcttaaatgtctactctggctaaaccttcacagccacttccagaagacctctgatttagagttctttcatactctgattttgtcttcctgtagctttttacctgaacctacctggntctaacccttctca

SEQ ID NO: 43643 - DNA, 205 bp, Homo sapiens
  misc_feature 52, 56: n = A,T,C or G
gggacatgatgctaagagtcctgggtaaatgtggtgagaatgcacgcgtgcntatnctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagct

SEQ ID NO: 43644 - DNA, 490 bp, Homo sapiens
gcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccgtcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggct

SEQ ID NO: 43645 - DNA, 468 bp, Homo sapiens
atggacacatgtctgcattatctttgtattcttctccaaggaggatgctcctagtgagtgagctgcctttctttgagagagagtgggaaagttaatgagttcacatttagaaagtactctggagtctttggtgattcaaggagtgttattaaattagtgggagatatgatacggagtggggatgctaaatacatatgagctccccaagggtgagtcatgtgtatgtgtacaggaaatgcatccttatttcatataagatcaagagttcaatcttacacctcccttgcctcctaatggaaaccaaacattcttcaaaactgctggatgcttgcttttctttacataactgcagttcagttggaggagtgagagaagtgaagctaatatttacagagagtacctactatgtgtcagatactttgcaatgtgttttacagaaatacataatcacattctttaaacaaccct

SEQ ID NO: 43646 - DNA, 245 bp, Homo sapiens
agataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtgtcaca

SEQ ID NO: 43647 - DNA, 442 bp, Homo sapiens
  misc_feature 27: n = A,T,C or G
catcatgaaaaagtggggagaaacagnacattttccagcagtgatcttccttattatgaataaaggtaacaaaggtggattctacggatggagtgctttcttatagacaactgtcaacgctctgggatccaattctctttcattaccgagtatacattgctgaaattgttctcagcttcttcacaaactcccttcacatactggccaagctatcactcactgtctaaccaccaaccaacacacctgatattaatcatatgctgggactcagtccatccaccaagcaaagattcttcatggctttcaagggcaattgtcaatattccagaccctaaaaggcccatccgacccagtgcctaaaatcaatattaactaaaagtaggaggtgttctttcctcttccttcctccagggaaagaaaagaagaggtgaacacaaaagac

SEQ ID NO: 43648 - DNA, 322 bp, Homo sapiens
  misc_feature 317: n = A,T,C or G
caagattaatttaacattacaaaaccgattaacataatacaccatatcagaagaataaaggacaaaaaccacatgactatctccacaccattaaaaaaaaagtatttgacaaaagtccacatccacacacattcatggtaaaaacattcaacaaactaggaaaagaaagcttccccaacgcgataaaggacatctgtgaaaaactcttggttaccatcgtacttaatgggaaaagattgaatgttttcccccctatgatcaggaacaagaccaagaaatccactatctccacttttatttaacattacagttaaagngttag

SEQ ID NO: 43649 - DNA, 264 bp, Homo sapiens
agaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattga

SEQ ID NO: 43650 - DNA, 425 bp, Homo sapiens
catttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcgcgcctgtggtcccagcactttgggaggccggggagggcagatcacttcaggtcaggagttcgagaccagcctggccagcatggtggacgctgtccctagtaaaagtgcaaaggttg

SEQ ID NO: 43651 - DNA, 465 bp, Homo sapiens
  misc_feature 15: n = A,T,C or G
tatatatctaaagtnagtttttattcaaagcacaatcttaaataaatgctaagttacctaccagttagaagtcaaactaggccctgtgaaacataataaaccctaaaaggtaatttttttcagatgtcacttacatactgttaaaagttttgggactgttcataaagacaaaattatactctacaaaacagcaattataatagaacaacttttactcaggttatttaaaaagagagagaatgtattaagaacagctgttggaaaaattcttcttttataagacacttcagaaatactcagtagagataaaataatataattttaaaactgaaagaactttcaggatgattagttttaagccaactcttttgcattcgagataggaaagccaactaaactgacaactgccctgaatgaaggtggggtccaatctacatctaaagatagtttcctgcctcatactca

SEQ ID NO: 43652 - DNA, 491 bp, Homo sapiens
  misc_feature 21: n = A,T,C or G
gttactgcattgaacagcagnagtcaaagcagtaattggaatagtttgacttgcagacctatggcattggctagttgatcatggtgttcctagaagtgaaatagataagaaacctctaacattcttatttgatctgtataaacagaaaagttctagtccaagtgaaaaaaagtctacactgagataagaacaaagccatagtcactcaattaatttccagatttgagccagtttacagaccctaaactccttcaatgaaagggaggtccctttgaagaaggaccccagtacaccaacaaaaatgtatactgttaatctctcttccaactttctacaaaagcacctttggtcttttaactgtgcaatggggaaaaggaaataatcagaactcttggggactactgaacactgggtctgagctgacactaatttcaaggtattcaaaacattactgtgctccatcagagtcagggcttagatctgtctcacag

SEQ ID NO: 43653 - DNA, 164 bp, Homo sapiens
  misc_feature 2: n = A,T,C or G
cnccgggaaatcggccttaggccggggtattttggaaaaaaaatcatagagttaaaatttctgcatggttaccagtttttctcacaacactgaatttggtagcttttcccgaaaaaatcttcacagtaattttttgtctgtatatatttgagggcctttttttg

SEQ ID NO: 43654 - DNA, 436 bp, Homo sapiens
ggaagctctgtttggtgctttggatccatttcctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttg

SEQ ID NO: 43655 - DNA, 186 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgaaaaaagaagataaagaaagaagat

SEQ ID NO: 43656 - DNA, 277 bp, Homo sapiens
caatgggatgaaaattttgggatgaaaatttgtgtgaacttaaattaagtgtctctgccgtcctggccaacatggtgaaaccccgtctctactaaaaatacaaaaattagctgggtgtggtggtgtgtgcctgtagtcctagctatttgggaggctgaggtgagagaatcgcttgaacccgggagatggagcttgcagtgagccgagatcacaccactgcactccagcctgggcaactcagcgagactccgtctcaaaaaacaaaacaaaacaaaac

SEQ ID NO: 43657 - DNA, 465 bp, Homo sapiens
gaagctaggtccttgtgaacttttccacaggaaagaaaagatcatgcgtgcacacggtttcttctgatttttcttaattagtatgtgcggaattttatcttcatccagactccatgattggttttccttaactgtagttgttctgaattaatttcatgtgggggaaaaataaagctacaaagtgatttttctaaagaatattgttgaagcattgttatgagagttcatctttcaaattttacttctaggatataggactttaaaagctccacaaatttgaaggaaagatggagattaaaaattcagttccagttacagcaacatcacacactctcattctctaacggagggcgagttatgtaaccttgctgggctttaggttcctcatgagttaatgctgtctaccctgagctccttacggggctgtcatgaggattgcaggttataacagctgtcagagcccat

SEQ ID NO: 43658 - DNA, 320 bp, Homo sapiens
ggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgc

SEQ ID NO: 43659 - DNA, 203 bp, Homo sapiens
gactggatggaggacccacaggaaggtattccatatctgtaaacaaagatatggaaatgagaagcagtcattgtcctgtgatcactgattgttcttttaatataagttcccacttcaatatgataaggacaccccattgggaagacaaaaaaatacagtagatcttaaatgttgtcaatatataggacacatacacacacatt

SEQ ID NO: 43660 - DNA, 254 bp, Homo sapiens
gtggtataagcactcaggtaagttataagaaatatctaataagatgattatctgtgaaaggatacgtttaagatgacatgcttttttaagatgaaatgaagtgaattccaaaagatatgtgtgataacctcgttaatatgttgatgataagtatttggaaccaataaagaagcaggtttgttgaccttaagcctgtatgagtttacttactgtgaacttactggtcactttgaaataaatactgtatgttcctg

SEQ ID NO: 43661 - DNA, 476 bp, Homo sapiens
gggctggcacgggggctcaattggcacttatgattacaaacttcgtccctctaggtatttacagctgacaatgtgctaatttatccaagcttcgtggttaagcttggcagaccagcaaatgcacccaaatgcaccaacaggtacatttcgaaaacagttcaaacaagaacagtttatattacaaaatgtgagaaacatcttagaaaaggcttgattttgaacaggtttatacacacttgcacacacagcctcttgctggtgctgttcaccttcctggacattcctgtcattcttggttaaaggtctttttcttccccagctactttgagaatttctccatatgggaaaggcagggaaggaacatgaagggggaaatgatggtcacaacaacttactggacccaactctgagccagggggactcatgggtaaagaaacctaacaggcagaatctgtgctcttatggaatttacactg

SEQ ID NO: 43662 - DNA, 318 bp, Homo sapiens
  misc_feature 9, 14: n = A,T,C or G
gcatcaagnaagtncgaaggggaaacaatagtctctttaataaataatgttgggaaaactgtatttctacatgcaaaagaatgaaattcaacccttagatcatacacagaaatcaactcaaaatggatggataaaagaccgaaataaatgtaagacttgaagctctaaaattcctagaagaagacataggagaaaagctccttgatcttggacttgacaatgattttttctttaatatcacactaaaagctcaggtaccaaataaataagtaaataaataatgggactacattaaactaaaaatctgcacagcagaga

SEQ ID NO: 43663 - DNA, 470 bp, Homo sapiens
atcttaatatttaaatttaaatctatttaatacttaatgttgctatcttttggatctcttgcgttggtactgtgcgtgcctggctttaaagaaaggtagagaatcttttcttcatttgatccttgatctataactcaaagctgtttttatgcattttgtgttttctgattttatatccttcatgttcttgtttttaagcagtattagtagtgaaaactggctgcgcgtggtggctcatgtctgtaatcctagaactttgggaggttgaggcaggcagatcacttgagcccaggagtacgagaccagcctggacaacatgacaaaacccagtctctacaaaaaaatacaaaaattagcgaggcatggtgtcatgtgcctgtggttccacttcctctggaggctgagttgggagaatcatatgagcccaggaggtcgaggctgcagtgagctatgatcataccactgcactc

SEQ ID NO: 43664 - DNA, 169 bp, Homo sapiens
  misc_feature 28, 30, 35, 96: n = A,T,C or G
aggccgggcatgcacaaacggtagtttngngtgtnggctgctccactgtcctctgccagcctacaggaggaaaagcaaggcttacagaaggatgtnccttcaggaggaagcagcactaaaagcactctgagtcaagatgagtgggaaaccatctcaataaacacatttt

SEQ ID NO: 43665 - DNA, 416 bp, Homo sapiens
ggaaaaagcatttgactagtctttttttaaagtatctgatttaagcacttttattttttaagccaattaattagagctcttttatgtatttttagtagtgaaacgttgtgtacacaacacataaatacatagatgtattaggcatgctgatagaagtacatgttatgatttttaaaacttcttttctttcttagacttctaaattcttaataacctgtttcaccatcctaggcaattgtcagctaaatagccctaaatttgtatttaaaggaaactacctcaggtgaaaatcaaatagcaaaatttatatcatatggtatggagagaaaaagtctggcgtgccaaagggaaattaaaaccaatttaactgccaattaaacataaaattatagaatttataaaggtcttttaaatac

SEQ ID NO: 43666 - DNA, 433 bp, Homo sapiens
  misc_feature 2, 16, 418: n = A,T,C or G
gnccgggaaatcggcnttaggccggggggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggntatgcatttgaaacc

SEQ ID NO: 43667 - DNA, 470 bp, Homo sapiens
attaaaaaaaaacaaataacccaattttaaaatggacaaaaattcaaataggcatgttctccagggaagatatacaaatggtcagtaagcacaaaaaaggatactcaacatcattagccgtcggagaaacgcgaatcggaaccaaagtgagatatcacttcatattcactgggatgctataatcaaataaacagataataaaagttgaggaggttgtaaagcaattagaacgctaatacactgctagtgggaatgtaaaatggtacagacactttggaaaataatttgacaggtcctcaaaaagttaaatatataatcacctgccatgtgacccagcagctccactcctagatatgtattcaagataattgaaactgtctacacaaaaatgtgtacagccatctctccatatcctcgggggattggttctaggaattcccccattcccagttactaaaacctgagtatgc

SEQ ID NO: 43668 - DNA, 306 bp, Homo sapiens
  misc_feature 101, 141, 176: n = A,T,C or G
aattttgctgtgtcgcctaggctggagtgcagtggtgcaatctcggctcattgcaacctctgcctccctggtttaagcaattctcctgccttagcctccanagtagctgggactataggcactcaccaccaagcctgtctntactaaaaacaaaaaaacaaaaattagctgggcgngctggcacatacctgtaatcccagctacacaggaggctgaggcatgaaaagtgcttgaacccgggaggcagatgttgcagtgagccatgatcacatgactgcattccagcctgggctacagaaagagact

SEQ ID NO: 43669 - DNA, 459 bp, Homo sapiens
cggccggaaccgccatcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgag

SEQ ID NO: 43670 - DNA, 142 bp, Homo sapiens
aacccaaatactattacataagattagcaatacttaaatgctgatatgaagtcagtaaatcttatgtcacacaataaaggaaaaggaaatacaataaagatattttcttagtacaagtgtatacatgcacaaacatgttttt

SEQ ID NO: 43671 - DNA, 384 bp, Homo sapiens
  misc_feature 10, 383: n = A,T,C or G
agtgtaaccntatgatccgcaattccactcctagacatatacccacaagaattggaaacaaagtcacacaaaatctcttctacacaaatgttcattgcagcattattcataatagaaaaaagtagaaacaatccaaatgcctataactgatgaatggacaaacaaaatacagtatatacatacaatggaatcttattcagccataaaaaggaatgaagtactgatacattcaacaatataagtgaaccttaaaaacatgccaagtggctgggcgcagtggctgatgcccataatcccaacactttggaaggccaaagtgggtggacccctcgaacccaggagttagacaccggtgtggacaacatggtgaaacctttcctctnc

SEQ ID NO: 43672 - DNA, 257 bp, Homo sapiens
  misc_feature 11, 234, 249, 255: n = A,T,C or G
gatttttgagnttgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggnatacaatgtctaccnacacgntg

SEQ ID NO: 43673 - DNA, 287 bp, Homo sapiens
gcatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 43674 - DNA, 107 bp, Homo sapiens
gtagatccgtgagggcgtgagcttggactggacccactgctgattccctgcacctagcacagtgcttgccacaaagtgggctctcaataaatattatttgtccaagg

SEQ ID NO: 43675 - DNA, 136 bp, Homo sapiens
  misc_feature 18: n = A,T,C or G
ggacttacgaagtatgtnatggaaaacacattcggcagtaccatgaagagaaagaaactggtcagaaaataaatattcacgagtactaccttgggaatatgttggccaagaaccttctatttgaaaaagaacgaga

SEQ ID NO: 43676 - DNA, 470 bp, Homo sapiens
gtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgacccttaagttcattgacaccacctccaagtttggccatggccgcttccagaccatggaggagaagaaagcattcatgggaccactgaagaaagaccgaattgcaaaggaagaaggagcttaatgccaggaacagattttgcagtttgggggggggtctcaataaaagttatttt

SEQ ID NO: 43677 - DNA, 359 bp, Homo sapiens
  misc_feature 7, 11, 43: n = A,T,C or G
ctcggcntctntggcccgggggggcttcttgagagctcctganttcttacctgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaaagtttgtaaaattcatacttaataaacaatttaggacagc

SEQ ID NO: 43678 - DNA, 471 bp, Homo sapiens
  misc_feature 5: n = A,T,C or G
gtaanagggcgatcttcagggaaggggcatgtagaagttttctggggagatggaaattttctgtctcaatctatatgttgcttgaaggtacaaccctatctaaaattaatcattacaggcataagccaccgtgcccgaacaagagacgttttctaagtcaaaggaataaatccaaagcctctaagactgggtgagagagaggaaaagaaatgacggaagatggtccagtacaaggcagagattttcaaaagggtggacatggctactgtattaaatattacttagaggtattcacaatagcgaaaaggtggaagtgatccaagtgtccatggaagggtgaatggataaacaaaatgtggtatatacatacaatggaatattatttagccttacaaagggaaggaaactctgacacatgctacaacatagatgaattttgaagacatatgctaagtgaaacaaactagtgac

SEQ ID NO: 43679 - DNA, 479 bp, Homo sapiens
  misc_feature 16: n = A,T,C or G
gcactttatttgtttntttgttttttgagatgaagttttgttctgtcacccaggctggagtgcggtggcgcgatctcggctcactgcagcctctgcctcctgggttcgggcgattctttcacctcggcctcctgagtggctgggattataggcacacgccaccatgcccggttgattttttgtgtttttagtagagacggggtttcgctatgttggccaggctggtctcgaactcctgacctcgagtgatctgcccgctttggcctctcaaagtgctgggattacagggaccatgcccggccacaacaggcactttagaatgcaggctcagtaaccaactttatgaagggagaaacagaggcatgaacagttgaaactatttccttaaagacagccagttccatcttgccatacagagtgcccacattttcagataatccgaagaggcatcacttagtgtccccagggaaatgaaaagc

SEQ ID NO: 43680 - DNA, 500 bp, Homo sapiens
  misc_feature 4, 5, 39, 58, 62, 63, 73, 479: n = A,T,C or G
ctcnntcagacgccaaacagctggcaccctcaacctgancctcctcaaggactgtctntacnntccagagacnttccagagttttagttttagcttagttccaaggaagaggaggtccctgttttacaggatagcctatttcagtcttagggagttctaatggttaacttctgttttcatacactgaatttaactttgttttcctgtgatttattaatacagtctatagctttcttagagttgagaagaaaatgattaattgatcaaactttttttgaaaagttaattgcatctcaagtgttttcttagatattgtttcatttttaggttccttataaaatacttcctacaggagtctttagtttttgaagttataaaaaaaaattatcagaggaaatatgactaatgtatatgctttggttgagctgcattttcttactgtttctatacttagtattttaacaggatgtgattgatanggaatttaacattctaattct

SEQ ID NO: 43681 - DNA, 382 bp, Homo sapiens
tatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagcta

SEQ ID NO: 43682 - DNA, 472 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacactcatagtaggcctaaaagcagccaccaattaagaaagcgttcaagctcaacacccactacctaaaaaatccca

SEQ ID NO: 43683 - DNA, 277 bp, Homo sapiens
  misc_feature 7, 8, 27, 32, 33, 37, 38, 43, 111: n = A,T,C or G
ctcggcnntctatggcccgggcaagcnagccnnagannttgcnatcaagcagtggggctctcagtaaggaacttggaatgcaagctggatgccctgggtctcttgggcacnagcctggcccctgtgcacccgagtggccatggcactgtgtggcccctgtctgcttatcctttggaaggtgacagcgattccctgtgtagctctcacatgcaccaggggcccatggactcttcagtctggagggtcctgggcctcctgacagcaataaataatttcg

SEQ ID NO: 43684 - DNA, 497 bp, Homo sapiens
  misc_feature 5: n = A,T,C or G
tggcngggaaaactactgaatgaagaagtattttggtaaccaggccatttttggtgggaatccaagattggtctcccatatgcagaaatagacaaaaagtatattaaacaaagtttcagagtatattgttgtagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaagccagccaagcttt

SEQ ID NO: 43685 - DNA, 467 bp, Homo sapiens
ggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcttgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcga

SEQ ID NO: 43686 - DNA, 251 bp, Homo sapiens
  misc_feature 70: n = A,T,C or G
tatggccgggagaggcgacaaacctaccgagcctggtgatagctggttgtccaagatagaatcttagttnaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactac

SEQ ID NO: 43687 - DNA, 305 bp, Homo sapiens
  misc_feature 14, 23: n = A,T,C or G
aaagtaaggaagangctggagantatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctac

SEQ ID NO: 43688 - DNA, 496 bp, Homo sapiens
  misc_feature 14, 428, 455: n = A,T,C or G
ggtttcctgatgcnagttgtgtggatgtgatcagttttacaaattcagtgaatcgtatacttatgatgtgtacctttctgcatgtctattatactaaaataggtaacaaatagaaatcctaaatctaatttaaatttcaatctaacaccataggtttttttccttctgcttctcccagttcttgtttgtctatctttttgtcctataatgaaaaagcttgattcccaaaaacatcaacgtatttattcatttgctcaattctatagtatataaaatcatttcagaattacaccaccaacaatattactactgctaacaaatctattaaggtcgagatttatttgcagttctttttgttcttagactatatctcattgagggtatacaatcaagactgcattcaaaagctgctttctttcatattaggntttttttaataatttttataatccttngggataggatttttcttgggaacccaattgggaaataagtc

SEQ ID NO: 43689 - DNA, 351 bp, Homo sapiens
  misc_feature 66, 68, 183, 200: n = A,T,C or G
tatggccggggcttttttttttcgtccttttccccggttgctgcttgctgtcctggtccgcgccanancccagcgcgcctcgtcgccatgcctcggaaaattgaggaaatcaaggacttcctgctcacagcccgacgaaaaggatgccaaatctgtcaagatcaagaaaaataaggacaacgngaagtttaaagttcggngcagcagatacctttacaccctggtcatcactgacaaagagaaggcagagaaactgaagcagtccctgcccccccggtttggcagtgaaggaactgaaatgaaccagacacactgattggaactgtattatattaaaatactaaaaatccc

SEQ ID NO: 43690 - DNA, 371 bp, Homo sapiens
  misc_feature 7, 11, 37, 43, 52, 60, 61, 62, 73, 85, 88, 101, 124, 127: n = A,T,C or G
ctcggcntctntggcccggggcttttccggcggtgancgaccntacgccacncgaataannngccctcttcgnaaggatctcctntcntccctctccagangaggagaagaggaaacacaaganganacgcctggtgcagaagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgga

SEQ ID NO: 43691 - DNA, 475 bp, Homo sapiens
  misc_feature 24: n = A,T,C or G
aggacaacaaggatatgaaaattnaggaccagggttctggacaggcttgggaactggcggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgattgtcagtg

SEQ ID NO: 43692 - DNA, 142 bp, Homo sapiens
  misc_feature 2: n = A,T,C or G
ancaaagggctccctgagggtctgggcaagggacctgcttctattagcccttctccatggccctgccatgctctccaaaccactttttgcagttttctctagttcaagttcaccagactctataaataaaacctgacagacc

SEQ ID NO: 43693 - DNA, 236 bp, Homo sapiens
  misc_feature 7, 8: n = A,T,C or G
gggaaannggctcagagatattaactgtcttggaaaatgagtaaaatatagagaaaacaaaactcctaccttgtgcaggttcaagttcaaatccagtaaataccatagtttaaagcatccctttacacaatggatttggttattttgcaaaacagatattagccccatgtgtcagtaatctacagtcatttgtaccttaacataaaatgccaaagcacagtaatatattcttagcg

SEQ ID NO: 43694 - DNA, 346 bp, Homo sapiens
  misc_feature 340, 344: n = A,T,C or G
aggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttagaagatagaaaaatataaatccnaaantt

SEQ ID NO: 43695 - DNA, 473 bp, Homo sapiens
gggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactacaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggag

SEQ ID NO: 43696 - DNA, 481 bp, Homo sapiens
  misc_feature 16: n = A,T,C or G
gtttcacaagaatganagtgaagcaggctatgttgggcactaaacagcaggaaacctagcaacataaagcaaccccaaaatgtccctctttatggtaaatttcataattgagcattgagaaacaggtgttttgataacaatagtgccgtattgtgagatctttacctcaatctgcaaactcacttctcgagagttttccccctttggattctggcttttattttttaatgatcattggcatgaattgccatgactttattgccagtctttgtcatggacttgtggcatttctcttcatgtgtcttaaacaggcagggagttaacttataggaccagagaattgggatattgaaacatttagatttaaaaaagaagtgcaaaatagaatttgatgtcggactctgtatggttcgttggatgaagatctctcattcaaaactagttataaatgtggacttaaagtatacttaaaaaaataaat

SEQ ID NO: 43697 - DNA, 124 bp, Homo sapiens
gaggaagaggatggagatgaagatgaggaagctgagtcagctacgggcaagcgggcagctgaagatgatgaggatgacgatgtcgataccaagaagcagaagaccgacgaggatgactagacag

SEQ ID NO: 43698 - DNA, 470 bp, Homo sapiens
aatgaaacccaagcttagacctattaatgcccaattagtggtctggttgtaggttaggaaacaccaccaacctgtgtatatacatatgtgatttacttccacataaatttctcacaactgagaaaaatagttagcagcgcaattctaaagataccatgtcagaccacttggattacctaaccacaaaaaagtataaaagatccagccaaagattttaatttctctttcacaatgtggaaactgcttcaaataaatgtgcacagcatcagaggaaggcccggttgttgcccatgtctttaccagcttcctgacatacttcaatacctaattgataccctgattctgaggctactgctccttcctgttacgctttctagattgcagtttgtttcgcagtgtagatttcagtgtgccctaagacatgttggcccttacaatcaactgtcattagaagagtagaactgacaatt

SEQ ID NO: 43699 - DNA, 226 bp, Homo sapiens
  misc_feature 4: n = A,T,C or G
aatnaaaatgtgatctagtgtagtgaaataaaatgtgatctagtgtaatggaagacctttgagaacctgggtgtattaactttgtgtatatagtgtaaatatccccactgtactgttagaggccaacaattctagtatggcttgttggcaaagagcgctacaccgtttcaatgaaacaatgtatgtttgttttaactgaactaaaataaatacatgcttaatcctg

SEQ ID NO: 43700 - DNA, 114 bp, Homo sapiens
  misc_feature 2, 17, 27, 79: n = A,T,C or G
tngccgggggtgctgangtgggagganagcttgagccctgggaagtcaaggttgcagtgagctgtggtgactccattanactccagcctgggtgacagggcaggaccttgtccc

SEQ ID NO: 43701 - DNA, 466 bp, Homo sapiens
gggccccagagcaggactgagtaaagagggtttgacagagctgcaaagtttgaaatgctttttgagaaatgaaaactgaagggtacagtgagagtgaactcaaggtcatgtgggctgagaggctgcatgtggatgggcttccttgctcggaatctgctctcttctccctttatcctactttgcagaacttctgaagtagctttaagccgctgtctggctctgtgaccctgggagagccacttgctttgttaaacatcgattttcctgtctgtaaagtgaagggacaggaccctttcagctgacacattctgtgaaataagattttattttttacgttttgataaagcatattaggggctttatagtaggatgtgatttaaggaatttgcttattctaattgagacacaatggtggggagtgggggtcggggactacacaggtgcattttctgaacatttataaaat

SEQ ID NO: 43702 - DNA, 447 bp, Homo sapiens
gaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaactgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaattt

SEQ ID NO: 43703 - DNA, 423 bp, Homo sapiens
  misc_feature 176, 300, 381, 389: n = A,T,C or G
ggcagcagaacaagaccccatgtcaaaaaaaaataaaaataaaaatcccaaaacaaacaaatttccctttaatcactgcttttgctgtacccaaaagttttatattatattttaattttcattcgtctcaaagcgcgttcttacctatcttgtgatttcttgtttgtgccattggngattaaggaatgtgttgtttaattttcacatatttttgaattttccatatttccttctgttgatttttaattccattgcagtcagacaacatatttggtatgatttcacttcttttaaattgtngaggcctgttttacaacctaacatatgctctatcttggagaatatttcatgcgcacttgaggagaatctgtattttactgnaattgggnggagagttctgtaaatgtgttttaggtctatttg

SEQ ID NO: 43704 - DNA, 482 bp, Homo sapiens
aacgttttcctcaagaaaaggtacaaaacacaaccgaggagcgtatacagttgaaaacctttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggaggggtattttgcttttttatcttcctggca

SEQ ID NO: 43705 - DNA, 426 bp, Homo sapiens
ggcacacagaccctaccactgcagacgaatgtcagcgtcacataaaaagagcatgtaggatgggacatattgggatgtattatatttggaaaatgcaatctgccataatgtcataacctttgttaacttaaaaaagatattttaggccaggcacagtgacacacgcctgtaatcccaacactttgagaggccgaggcgggcagatcacttgaggtcaggagttcgagaccagcctggccaacgtggtgaaaccccttctccactataaatacaaaaattagctgggtgtggtggcacacacctgtagtaccagctactcaggaggctgaggcacgagaatcacttgaacctgggaggcagaggttgcagtgagccgagatcgcgccactgcactctccagcctggataacgggagcgtggctccat

SEQ ID NO: 43706 - DNA, 144 bp, Homo sapiens
acaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 43707 - DNA, 471 bp, Homo sapiens
catgggaaacctggggaagagctgtcctctgttctcacctcactttaagcaggtagtggttttggttgatgcttcctcgtttgatgtggtaaaatggtaagtctgtgggttttgctgcaggtttagagaattctttaagaatgtctttgtgtggcatatgctttggtcacaatatctggtgcttaggtaacttgctatttaatttccatggtgaaatgtaaatgttccacatatcacttaaataatgggaagaccccatcttcattcatttaaacatggcctaggtaatggctttctcttattgagccttttagaaataaaaagtctgaagtttgaatcatgtggctttcttggagaaacttttatttttttttgagacagagtctcactctgttgcccaggctagagtgcagcggcgtgatcttggctcactgcaacctccacctcccaggttcaagcgattctcctgtc

SEQ ID NO: 43708 - DNA, 482 bp, Homo sapiens
  misc_feature 45, 303, 325, 330, 395: n = A,T,C or G
gaacactctgggttttacagcattaacctgcctaaccttcatggngagaaatacaccatctctcttctagtcatgctgtgcttgccggcttactctgttggggtctatataaatttgttgaactcttacctacattccaaagaagtttcaaggaaccataaatatatgtatacatatacatatataaaatatatatattaaaataaaattatcaggaatactgcctcagttattgaactttttttttaagaatactttttttttaagctgagaagtatagggatgaaaaagatgttatattgngtttgactattttccaacttgnatttncatataatttatattttttaaaagctgaaaatttagaagcaagatgaaaaaaaggaaaagcaggngctttttaaaaatcagaactgaggtagcttagagatgtagcgatgtaagtgtcgatgtttttttaaaaaaaaaatgcaaaaaaattc

SEQ ID NO: 43709 - DNA, 472 bp, Homo sapiens
  misc_feature 462: n = A,T,C or G
gacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaaggaagtgaagcttatcaagaagatggggtgaccacctgaccaacctccacaggctggggtggcccggaaggctgggctgggccnagtatctctt

SEQ ID NO: 43710 - DNA, 476 bp, Homo sapiens
gggaggctgaggcaagagaatcacttgaacctgggagatggaggttgctgtgagccgagatcatgccactgtccgccagcctgggcgacagagaccctgtctcaaaaaataaaaaaaaagtaaagaagagtggctcctgggccagcagcttcagcctcacatgggaacttattagaaatgcacattttgggaccccacctcggatgtgttgagtcagcaactcactggcagaacccagcaaaggccctttttaataagccttccaggtgattctcatgctgctaaaatctgggtaatcactgttttcattttcttttatatgtattattaaatgactgttactctacaaacatatggttgttatttttactttttggataccattatagtgtaggcatttcccaggtttttttggtaacaccattttcttaatgatatgatgttgcagccagtggatttattacagtcttacttat

SEQ ID NO: 43711 - DNA, 472 bp, Homo sapiens
  misc_feature 471: n = A,T,C or G
gaggcattgaggcagccagcgcaggggcttctgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggng

SEQ ID NO: 43712 - DNA, 330 bp, Homo sapiens
  misc_feature 53: n = A,T,C or G
gtaacagagaggaggatcttcatacattcctatctggtaatagtattaaaatnaattgggtatgatggttcacgcttgtaatcccagcactttgaaaggccaaagagagaagatcacttgagcccaggaatttgagaccagcctgggcaaacatagcaagacgctatctctacaaaaaatttaaaaattagctgcccgtggtggcacatacccagctactcaggaggctgaggccagaggatcacttaagcacaggaatttgaaatggcagtgagctataattgtgccactgcactccagcctgagcaacagggtgagaccctgtttctg

SEQ ID NO: 43713 - DNA, 468 bp, Homo sapiens
ggtatacgtatacacaatggaatcctattcgacacaaaaaaaggaaatgctgtcgtttgtgacaacatggatgaatctgggggacattatgttaagtgaaataagccagacacagagagacaaatactgcatgatttcacttacttgtggaatctaaaataaatcgaactcgtgggagcagacagtacaatggtagttaccaggaactgggggtggggatggggagatgctaggtaaaaaatctcatacccaacttgctcatttccttctgcatccatgcctaccgggtgcagtaggatggaagcaaggttagcagggccctgcacagatgctgaaggtttcaagaagacactgagagaccgctgggcccatgtgcactgaaggcctggatgaccacagagacgtggacatgcggaacgtccctgtgaaaataaattgctataagcatttaaagcagcagaagtgagc

SEQ ID NO: 43714 - DNA, 395 bp, Homo sapiens
gaaataaaagaacaagaaagaggccaaaaagacaaagagctataaaccaacggagataagataacaaaattactggatcaactcaggaatttcagcagtaagatttctagaaagaaaaagtagagaaagtgaattgaagaaagataaaacagaaacagccaggaaaactcctatgacaagaggacatgaccttctagattgaaaatcttcatgaaacactgaataacaaacttttaaagatttattttaagacatcttgaaatttaagaatacccaaaataaaattcttagagattttttaaaccctaagtatatataatcagcatgacatcagactttccaatgtagcaccgtaagatataagacaataaattaatgtttacataattctgaga

SEQ ID NO: 43715 - DNA, 464 bp, Homo sapiens
atttcttaatgttagctgtataaaacaaaaatttgttctgataaaatttttaatatgggcctttatttgccaataaaatcctttgtaaatgtgagctttattaaactgtttaaatagacaaagttaaagcttaggatagggaatatatatgtatgtgtatatgaaatgatgtcttcgagttttaacttccagcctgagatggcctagatttggtgtgttagtttgtttcactgaagtcagtgagataggagtctagctgggtacatgcttaaaaagctggaagtgaagtgggtggcaagtggcagctccctctttcatgtagttttccataatgttcatatagtttccttatggtctaagtgttacaactggttttcaagttgttatattgaatattcctttttggaattcagggttgaatcactttgagggggaagggaagcaagggcaagagactttatttt

SEQ ID NO: 43716 - DNA, 376 bp, Homo sapiens
gtggtttccagacccttgtttcagttctccatgagggcctttaataagttttaattgctaattctttggatgtagaaataacccaacagccagacagggcacagtggcgcaagcctgtaatcccagcactttgggaagctgagttgggcagatcacttaagatcaggagttggagactggcctggccaatatgatgaaacccgatgtctaccaaaacatacaaaaattagcttggtgtgggggtgcacgcttgtaattccagcttcttggaaggctgaagtgggagaattgcttgaacctgggaggtggaggtcacagtgagccgagatcgcgccactgtgctccagcctgggcgtcacagagtgagactctgtcc

SEQ ID NO: 43717 - DNA, 273 bp, Homo sapiens
agatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtga

SEQ ID NO: 43718 - DNA, 309 bp, Homo sapiens
atttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatc

SEQ ID NO: 43719 - DNA, 471 bp, Homo sapiens
  misc_feature 299: n = A,T,C or G
gtgtgtgtgtgtgtgtatatatatatatttttttaaatcacattaattttaccaagtgaaaccaagccatactgtttttgagccaattaagaaaatcgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggntgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatatt

SEQ ID NO: 43720 - DNA, 171 bp, Homo sapiens
  misc_feature 37, 48, 59, 72, 83, 94, 115, 123, 137, 149, 164: n = A,T,C or G
gttgatgagggaggggaaactttttttttttctatanacttttttaanataacatcttntgagtcataaccngcctggcagtntgatggcctanatgcagagaaaacagctcctnggggaatngataagtaaaggcngaaaagattatntgtcatacctccatnggggaat

SEQ ID NO: 43721 - DNA, 466 bp, Homo sapiens
gagcgaaggcatatggatgcaaaggaacatgacccattagggagccagcccggacatcaagaatatggacccacgcagaagattaacgggtagagctaataagggagacaggctaggtcattggccatgggggagggcctttttgtttttttttggagaggagttctccctttgccttccaggctggggtgccggtggtgcccgtcatagctcattgcagccttgactcctgggctcgagtggtcttcttgcctcagcctcgcaagtagcagacactggaggcacaagccaccacacctggctagttttttaatttttgtaaagatggggtctcactgtgttgcccgggttgatctcgaccacctaggctcaagcaatcctcctgtctgggtctcctaaagccctgagtctataggccagagccactgtgcgctgcccaaggggaccttttatgttatgccaaaat

SEQ ID NO: 43722 - DNA, 296 bp, Homo sapiens
  misc_feature 8: n = A,T,C or G
gggttccnttttttaaatgtttaaaaatatgttgacatggtagttcagttcttaaccaatgacttggagatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccccttacagcacaaataaagtttgagttctaaacgc

SEQ ID NO: 43723 - DNA, 467 bp, Homo sapiens
gaactattttacattcccaccagcaatgtatcagttttccaatatcttcacatcctcactaacacccagtttcctttttttgattattgccattctagtagatgtgaagtggtaccttattgtggttttcatttacatttcactaatgactaataaggtcaaacatcttttcatatgcttactggtcatttgtatatcttctttggctagatgtctactcatgtcttttacccaaagtctaattttgttgtttgtcttttcattgttgagtcataaagagatcttaatatgtattagataatagacctttatcctatacctaatttgcaaatattttcctccatctttaggctatctttttactgtcttcataatgtcctgtgatgcatcacagtttctaatggttatgaagtgcagtttaacaaatgagatgtgagcaaaagggatgagtgtaatttctggactgc

SEQ ID NO: 43724 - DNA, 226 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagtgttaagtttttaacgtaattttaatagcttaagattttaagagaaaatatgaagacttagaagagtagcatgagg

SEQ ID NO: 43725 - DNA, 467 bp, Homo sapiens
ggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagaca

SEQ ID NO: 43726 - DNA, 467 bp, Homo sapiens
  misc_feature 405: n = A,T,C or G
aacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggnggggtttgcctagggacgtgtaactacaggcttttactaagccaaggaaaaagagaattttt

SEQ ID NO: 43727 - DNA, 156 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgct

SEQ ID NO: 43728 - DNA, 134 bp, Homo sapiens
  misc_feature 3, 10, 134: n = A,T,C or G
gcnagaaganctcccttcggtgccgggcgcaggaactgtgtgtgtcctacacaatggtgctattctgtgtcaaacacctctgtattttttaaaacatcaattgatattaaaaatgaaaagattattggaaagtn

SEQ ID NO: 43729 - DNA, 296 bp, Homo sapiens
  misc_feature 16, 20, 214: n = A,T,C or G
atacttaaattttagnaagnagatcaaattattttaatgactaggactatgcttatgaagttagcatttcctgcccttatttatagaaagcacttgatatatttcacaaaggtgaggagattaactttttagggaacaagtcatttaaattcttgaaccagtttccatcttttaggctatacgagtattgaatataggagaaaagagaaaagtntgcatgtttctcaaaggctctttctttaaatgtcaccagcagatctaaacagtatccataggcacctatggcaaatttacac

SEQ ID NO: 43730 - DNA, 197 bp, Homo sapiens
atttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccc

SEQ ID NO: 43731 - DNA, 287 bp, Homo sapiens
cactttttacaacgtcaaggaattaagcataaaaaagattggttaaaagctttggtttctagtaaaggttagtgtgtgtggttttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaact

SEQ ID NO: 43732 - DNA, 283 bp, Homo sapiens
  misc_feature 195, 204, 224, 231, 255, 268, 277: n = A,T,C or G
gctcatggatgggtagaatcaatggtgcaaaaatgaccatgctgccaaaagcaatctacaaattcagtgcatttctcatcaaaataccaccatcattcttcacagaattagaaaaaaaaaattctgaaattcatatggaaccaaaaaggagcctgcctagcccaagcaagactaaggaaaaagaccaaatctggnggcttcccnttacctgacttcaaactacncttttanggccttgtccccaaaccgctgggnctgggttaaaatngttttttgngccctg

SEQ ID NO: 43733 - DNA, 213 bp, Homo sapiens
aaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttcctt

SEQ ID NO: 43734 - DNA, 204 bp, Homo sapiens
  misc_feature 204: n = A,T,C or G
cgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagcn

SEQ ID NO: 43735 - DNA, 473 bp, Homo sapiens
ggagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattcccagaagatattctta

SEQ ID NO: 43736 - DNA, 471 bp, Homo sapiens
attgaccctgcattgcaaacacaggttcgggttccctaagtcccacagtgtagtgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtatt

SEQ ID NO: 43737 - DNA, 103 bp, Homo sapiens
aaagctagaaacactaggttcttcctgtacatacgtgtatatatgtgaacagtgagatggccgtttctgacttgtagagaaattttaataaacctggtttcgt

SEQ ID NO: 43738 - DNA, 310 bp, Homo sapiens
  misc_feature 7: n = A,T,C or G
agacaangacctagcaatggctcagtgagtgtcagtgatgattatccccaagtaaaataaatttgaatttaaaattttaaaaatggtcatttttgcatccatggtcttgagccaaatgggaaacggtttggttcagcctctaagcccctgcgggtaggccctgggtctttcagccctgtgtctgctggtacgcctggggctcaggaaatgcacatggtgtgttaaaaccaagtttgaatttgtcaaatcccaagtcaatccaggatgttcatttcttaaatgatacagtgagacaaagtttttttgaaga

SEQ ID NO: 43739 - DNA, 108 bp, Homo sapiens
  misc_feature 8: n = A,T,C or G
tgaatgcnagcttataaagcacaaagcatacatttcctgactggtctagagaactgatgtttcaatttacccctctgctaaataaatattaaaactatcatgtgacta

SEQ ID NO: 43740 - DNA, 202 bp, Homo sapiens
  misc_feature 31: n = A,T,C or G
gagaccagcctggccaacgtggggaaacccnatctctactgaaaatacaaaaattagccgggcatggtggcacaagcctgtaatccttgctaaccaggaggctgaggcaggagaatcacttgaacccaggaggtggaggttgcagtgagccgagattgcaccactgcactccagcctgggcagcagagtgagactccgtctc

SEQ ID NO: 43741 - DNA, 366 bp, Homo sapiens
  misc_feature 7, 33: n = A,T,C or G
aggaagnaaatggtgcaaatttcaacaataccnactggggtgaacaaaaaatccctgaaacaccccattccagctattgttatctggaaaaaaatccttacaataattagatggtgatttgacgtctgggggaagttgcagatatagttttaatttactgtaggactagtggcagtgagtctcatattgctgtcatataaaaggtaaaccttccagaagaactttggaaatttcagtagcctaaagaccacgctttgagaaactcgtaaaggtttgtcatagaggttttaaaagtctgatcaaataattttaagctttagttgcctactaaaaagtaggatgcagtacaagtttgtcctttacttg

SEQ ID NO: 43742 - DNA, 192 bp, Homo sapiens
ctggccaacatggtgaaatgccgtctctactaaaaatacaaaaagtagctgggtgtagaggcgcacgcctgtgatctcagctgctagggaggctgaggcaggagaatcgcttgacctggggaggcagaggttgtagtgagctgagattgtggcactgcacgccagcctgggcaacagagtgagactccatct

SEQ ID NO: 43743 - DNA, 440 bp, Homo sapiens
  misc_feature 3, 31, 32, 34: n = A,T,C or G
ggnaggcgcctctctccctactgctgctacnntngtaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaatctctttttttctggaggctggcacctgattttgtatccccctg

SEQ ID NO: 43744 - DNA, 300 bp, Homo sapiens
  misc_feature 6: n = A,T,C or G
aatttngcaaccctagctcattttttaattatcctgtgcctcaatttccttacctataaaacagaaataataatagtgcctacctcttagggttgttggtttggtacttgcaaagtaatacaactatccctgacacagtataaatgaactattatataatgaattactctaaatttgatcttctttcactaattaatttctgttacataagggaaatctttagaattttcagccttactagatttggagaaggataactgaacaccaacaatggttctcaagcaaagagtaaacaacagc

SEQ ID NO: 43745 - DNA, 373 bp, Homo sapiens
  misc_feature 23: n = A,T,C or G
cttagtgactttcttccaaggantggggtgtggaggaagtaactttacagtgaagaaactttacagtacaactcagccgggtgataaaggttaattaacatcattggtaatcaatgaggttgatagtgtgtacccttgatatggcgtgatggcaaagggcacttcatctcttgtggtcttccttccaaaaacctataacctgaatctaaccatgacacacatcagacaaactcagattgagggacattctatgaaatacccgaccagtattccttgaaactgtaaggtcattagaaacaaggaaaatctaagaaactgtcacagccaagaggaagttaagaagacataatgactagctgtaatgtatactaga

SEQ ID NO: 43746 - DNA, 337 bp, Homo sapiens
  misc_feature 4, 9, 32: n = A,T,C or G
gaantaccnactttgcgaacgctacgccatgntttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatacttt

SEQ ID NO: 43747 - DNA, 116 bp, Homo sapiens
  misc_feature 8, 69: n = A,T,C or G
tatggccnagggaatggcctgttatgataggacgtagtagtatcggtggtcagacatggaaatggtggngagacaaaaatatacatgtgaaataaaactcagtattttaataaagt

SEQ ID NO: 43748 - DNA, 366 bp, Homo sapiens
  misc_feature 33, 154: n = A,T,C or G
ggtgttcggcatttcgtataccatttaataatntgaagggagcagtagctgttaagaaaaatagccaggtgtggtggctcacacctgtaatcctagcactttgggaggctgaggctggaggattgcttgaggccaggagttgagaccagcctanagaacatagtgagaccccccgactgtataaaaaaattagcgagatgaggtggcactttacctgtagccctagctacttggaagctgaggtgggaatattccttgagcccaggagtttgagctgcagtgagttatgagtgtgccactgcgctgtagcctgggtgacagagtgagaccctgtctctaaaaaataacaataaataaaaatttttt

SEQ ID NO: 43749 - DNA, 286 bp, Homo sapiens
  misc_feature 8, 9, 34: n = A,T,C or G
atactaannaagacaaacctttgaaaggttacanttaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttat

SEQ ID NO: 43750 - DNA, 411 bp, Homo sapiens
atggccggggtatatcatatatatgtacagttatctaagtttatttaaagttgtttgtgcctttttatttttgtttttaatgctttgatatttcaatgttagcctcaatttctgaacaccataggtagaatgtaaagcttgtctgatcgttcaaagtatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgaga

SEQ ID NO: 43751 - DNA, 458 bp, Homo sapiens
  misc_feature 7, 33: n = A,T,C or G
accgtgnctgtttctgcccttgtgcctagttangagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtacccgttgtccccacagtgttccgtgg

SEQ ID NO: 43752 - DNA, 159 bp, Homo sapiens
  misc_feature 34, 159: n = A,T,C or G
gactctcagcggtggatcactcggctcgtgcgtngatgaagaacgcagctagctgcgagaattaatgtgaattgcaggacacattgatcatcgacacttcgaacgcacttgcggccccgggttcctcccggggctacgcctgtctgagcgtcgcttgcn

SEQ ID NO: 43753 - DNA, 477 bp, Homo sapiens
  misc_feature 32: n = A,T,C or G
gaatgtctgtcatctgtctgtgtgtctctctntgcatctgtgtgtgggatgggggccctgtttagagggaaaatattcctccacgttgctgctgtcttttcctcaggggttatgtttgtgtgtgtggaggggtgtgtgcctgttccagaaagacccacagagagtcttggcccagaaccagagccctccccgtgagcagggacccaggccactctcctatacctgcttactcctgagcaggggaagacatctttcttgctttcttaggcacttcccagactctgaggcttcctggtgcagacagtaggtgtctgtggatgttttctgcctgcctcgtgttccctggacagccctgcctcttagcttggctccaggaaagcattgcagcagggttggtggctgcatgcgctggggactatgctagtcccctcctctctggacaggtcccatgtgccaaaccagggaagaccagggaga

SEQ ID NO: 43754 - DNA, 464 bp, Homo sapiens
  misc_feature 9: n = A,T,C or G
aaagaagtnaagatgcaggtggtgctgaaggagatacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcg

SEQ ID NO: 43755 - DNA, 165 bp, Homo sapiens
  misc_feature 8, 35: n = A,T,C or G
caaccagntggagatcaagcccgagtatgatcggncactacctgggcgagttctccatcacctacaagcccgtaaagcatggccggcccggcatcggggccacccactcctcccgcttcatccctctcaagtaatggctcagctaataaaggcgcacatgactcc

SEQ ID NO: 43756 - DNA, 178 bp, Homo sapiens
  misc_feature 7, 31, 32, 34: n = A,T,C or G
gtgaagnatctaggttgtgtgctccttatgnnantctaatgcctgatgatctgaggtggaacattttcatcccaaaatcatccccctgctgtggaaaaattgttgtccacaaaactggtccctggtgccgaaaaggttggggatcgctgctatagattatatgcattgtctcctatcc

SEQ ID NO: 43757 - DNA, 464 bp, Homo sapiens
  misc_feature 8, 9, 32: n = A,T,C or G
cagcaccnncagcctttctaccaggtttggcnccgtagctgttcctaatattttattatttcaaggagctaaaccaatggccagatttaatcatacagatcgaacactggaaacactgaaaatcttcatttttaatcagacaggtatagaagccaagaagaatgtggtggtaacttcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacatttcctccagtgacgtgttgacttgaaacttcaggcagattaaaagaatc

SEQ ID NO: 43758 - DNA, 378 bp, Homo sapiens
  misc_feature 2, 4, 27, 29, 30: n = A,T,C or G
ancngacagcttttgcagacttagacntnntctgtctgatggctctaaagagagcaatggttctctcggcatggcatccgagctccaagaacagacagactgcctccccaagcaggtccctgacccccatgtagctggactgggaaacacctccccatcaggggctgagagatacctcaaacacgtgggtgcccctctgggacgaagcttccagaggaaggatcaggcagcaatatttgctattctgcagcctttgctggtgatacccaggcaaacagattctggagtggacctccagcaaactccaacaaacctgcagctgaggggtctgactgtgggaaggaaaactaacaaagagaaagcaatagcatcaacctc

SEQ ID NO: 43759 - DNA, 482 bp, Homo sapiens
gacaccccctggaattacaaaagaaaattgtatttttaaatcttctaacagaaaaagaagtaaatattgttttgccaacacagtccattgttccaagaacttttgtgcttaaaccaggaatggttctgtttttgggtgctataggccgcatagatttcctgcggggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgtaggttgggtttcagtaacacctaattttaaggacagactgcatctccgaggctatacacctgaaggaacagttttgaccgtc

SEQ ID NO: 43760 - DNA, 482 bp, Homo sapiens
  misc_feature 30, 32, 33: n = A,T,C or G
ggaaagcagagcggaggtggtggcggcggntnntttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactg

SEQ ID NO: 43761 - DNA, 234 bp, Homo sapiens
  misc_feature 4: n = A,T,C or G
tatntagtaaagcttttcttttttaatttccaggaaaaaataaaaagagtatgagtcttctgtaattcattgagcggttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacact

SEQ ID NO: 43762 - DNA, 429 bp, Homo sapiens
  misc_feature 8, 33, 36: n = A,T,C or G
ggaagaancggcttgccgaaattgaggacatgnttnaaattgcagtgaagtttgaaatgtcttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccg

SEQ ID NO: 43763 - DNA, 289 bp, Homo sapiens
  misc_feature 2, 5, 47: n = A,T,C or G
anctngggccgggggcgacaccacctaccgagcctggtgatagctgnttgtccaagatagaatcttagttcaactttaaatttgcccacagaaccctctaaatccccttgtaaatttaactgttagtccaaagaggaacagctctttggacactaggaaaaaaccttgtagagagagtaaaaaatctaacacccatagtaggcctaaaagcagccaccaattaagaaagcgttcaagctcaacacccactacctaaaaaatcccaaacatataactgaactcctcacac

SEQ ID NO: 43764 - DNA, 465 bp, Homo sapiens
  misc_feature 35: n = A,T,C or G
gggaatcacaacttcggtcgtggaggaaacttttntggtcgtggtggctttggtggcacgccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagac

SEQ ID NO: 43765 - DNA, 475 bp, Homo sapiens
  misc_feature 33, 35, 424: n = A,T,C or G
agctcaccttatgtaagatgaaaaaataactgntngtcaaggctcagcctccagatggactcccttaattcagttacccactttaatcctatcacatgaggtgcagaagggtgacatttagccatctaggtccatatattcagcagcagagactaaggacaggaggatcaggtaagctcaacacaccaaaacatatccggcacaatatccttgccactttcactgctgtttctatagtttcattcttactgatagactatttgtagtggcatcctgacttactttctggatagagagacagatcaaaaacaggtggtcatgtaaatgaccacgtatttttattaggatgttctcatggcacttagtttttatttttctcaaagtaatgcttatttataactctgtctataattagggaaacatngggagaaactatgtttccctgtatgttcaatgaatgttcaataaatgaaag

SEQ ID NO: 43766 - DNA, 258 bp, Homo sapiens
tctgtgccagtggaagggaaaatgacggtttctttcctatactgtcctttgtttggaatggtgaaaatgttttgaatctgtttctggtgtgatcgttaggtccaagatttcacgtgacgttgtgtgccgggtgttgtggtcaacacacaggaatgctcctttattctctgtacggcctttgggtgcatcatttgagtggatgttcatttgcttgagacgattgtcagagggaatcttgtgtgccctttgctctctgtg

SEQ ID NO: 43767 - DNA, 278 bp, Homo sapiens
  misc_feature 3, 8, 35, 263: n = A,T,C or G
tgnagcgnctcacgcctataatatcagcccttttnagaggccaaggcgggtggataacttgaggtcaggagtttgagaccagcttggccaacatggtgaaaccctgtatctgtgaaaaatacaaaaattagctgggtgtggtggtgcacatctgtagtcccaagctacccgggtggctgagacaagagaatcacttgaacccaggagggggaggttgcaagtgagccgaggttgcaccactgcactccagcctgggaaacagnagcagcaagatcctg

SEQ ID NO: 43768 - DNA, 342 bp, Homo sapiens
  misc_feature 2, 3, 28, 31: n = A,T,C or G
tnnccggcggtgacgacctacgcacacnatnacatgcctctcgcaaaggatctccttcatccctctccagaagaggagaagaggaaacacaagaagaaacgccaggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 43769 - DNA, 128 bp, Homo sapiens
cgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 43770 - DNA, 388 bp, Homo sapiens
  misc_feature 33: n = A,T,C or G
agccaccctggttcaactttgtgtaataaattntcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctaca

SEQ ID NO: 43771 - DNA, 500 bp, Homo sapiens
  misc_feature 25: n = A,T,C or G
taatttctaaggtacagttgctctnttgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagca

SEQ ID NO: 43772 - DNA, 410 bp, Homo sapiens
  misc_feature 31: n = A,T,C or G
ataaaaccatttgttaaactggtccttagtnttttgtataattagaaatgaagtttgggaaaaaattttggaaaaaagacaagcaaaaaaaataacttattccttttttgcatatttgtatagccttctagaatcagaaataacctttttgcatattcttttattgttctgacttttcaagacctattatttttttacataggtcaataaacaaaaggtgtgctactgaaaatgtttacgttttcttccatttatgtcaggggttcatgtgaagcaggtcgcagtgctctacttcaagtaatcatattgggcaaggcttcggatttttatttatagtattaccgtattttattaattccgggatgtacatttttaaatatttacattaaaaacatagttcatctttttat

SEQ ID NO: 43773 - DNA, 174 bp, Homo sapiens
  misc_feature 6, 12: n = A,T,C or G
acaganacaagnatttcaaataaaactgtctttggcagtgagtaaatagcatattttgaagtagagttgtatactttttcataaggtgtttgggaatttttttcctgaagtaataatttattccacatctacatcagtgaaagctatctacctatcctgagtctatcttaaagg

SEQ ID NO: 43774 - DNA, 179 bp, Homo sapiens
  misc_feature 178: n = A,T,C or G
gagtctctatgtacagacaagtctcagaatcctattcctaaagtgcgtgagaggctgggcaaggtggctcatgcctgtaatcccagccctttggggagccaaggtgggcagatcacctgaggtcaggagttcaagactagccttgccaacatggcaaaatcccatcttactaaaaatnc

SEQ ID NO: 43775 - DNA, 486 bp, Homo sapiens
  misc_feature 24, 485: n = A,T,C or G
ctcgggactgagtgcaagaatcancatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaattcgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttgggng

SEQ ID NO: 43776 - DNA, 440 bp, Homo sapiens
  misc_feature 2, 8, 32, 34, 58, 83: n = A,T,C or G
gntttccnacttggacgctgcagaatggcttntncaaagaagggtggcgagaagaaanagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccacttttcaaaaatctacagacagtcaatgtggatgagaactaatcgctgatcgtcagatcaaataaagttataaaattac

SEQ ID NO: 43777 - DNA, 225 bp, Homo sapiens
  misc_feature 223: n = A,T,C or G
aacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttntt

SEQ ID NO: 43778 - DNA, 279 bp, Homo sapiens
actgaaccacttagatagagcaatcagacaagtatagagaaataaagggcatccaaattggaaaggaagaagtcagattatccttgtttgcagatgatattatcttttatttggaaaaacctgaagactcttagccaggcatagtgacatgtgcctgtagtcccagctacatgagagcctgagacagaaggatcatatgagtccaggaggtcgaggctacagtgagctgagatcctgtcactgcattccagcctgggcaacagaatgagaccttatctc

SEQ ID NO: 43779 - DNA, 285 bp, Homo sapiens
atgtttaaaaatatgttgacatggccgttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattac

SEQ ID NO: 43780 - DNA, 498 bp, Homo sapiens
  misc_feature 2, 9, 27: n = A,T,C or G
cncacaagnatggcgccgaaagcgaanttttaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccgaagacagcccaaatatcctcggaagagcgctcccaggagaaacaagcttgaccactatgctatcatcaagtttccgctgaccactgagtctgccatgaagaagatagaagacaacaacacacttgtgttcattgtgggatgttaaagccaacaagcaccagattaaacaggctgtgaagaagctgtatgacatttgatgtggccaaggtcaacaccctgattcggcctgatggagagaaagaaggcatatgttcgactggctcctgattacgatgctttggatgttgccaacaaaattgggatcatctaaactgagtccagctgc

SEQ ID NO: 43781 - DNA, 312 bp, Homo sapiens
  misc_feature 36: n = A,T,C or G
gatatggccgaatgattgatcatactttacatgatncatagctgtatattaacagttcatcagtaggttgcttctgagccttctcgtttatacactattcgatctgtattgtgatttattatttgtttcattattattgttattaatttattattgaagtttattttaattataatattgtgtaagtctatgttatagtagcatggcatggtggcaccctcctgtatttccagctattcgggaggctgaagtgggaggatcgctttgagcccaggagtttgagtccagcctaggcaatgtatcgagaccctt

SEQ ID NO: 43782 - DNA, 153 bp, Homo sapiens
  misc_feature 7, 59, 79, 133, 144: n = A,T,C or G
ggaagcncaggtttatgttgaggattctgtttttggaattgtgtgagctaggaatggcngaggggagactttcaatggntaaggctccatttctcattttcccaacttttatatgattgtctatgggcagttngaatttctggntttcaattt

SEQ ID NO: 43783 - DNA, 351 bp, Homo sapiens
  misc_feature 7, 8, 34: n = A,T,C or G
gatgatnncactgctccgacagccaatgggctgngccatgacgtcaccactctgacagcatgtgttcctgggctttaaaagttcctccaaagttggttaagggatacagacatacagttaggtagaaggaacaagtgttataagttaacaatattttcttgtatatttcagtatagctaaaagagatttgtaatgttcccaacagaaagaaaagacacatgtttaaggtcttatatatcccagttaccttgatttgatcatttgcacattgtatatgtgtatcagaatatcacatgtacccccaaaatatgtacaacctaatatagatcaataaaaataaataagctttgc

SEQ ID NO: 43784 - DNA, 375 bp, Homo sapiens
  misc_feature 1: n = A,T,C or G
ntggccgggcaacttcctggttacttgtcttgaattggaagttgaactgagactatgtagatggattaagttctgattatacattattgatttggcaaattggaacaatttggacaaattaaaatttgaaggtttcttggcaagaacaacattttaagaaaaaaattagtaaatcatttttatatttgtacatagaatctccacaactcttcagttatggacccagaagtggcatgtgtcatccttattattttgtatcctttacttacgtttaagttgtatttacattcttctataggtcttgatattaaacattcattttcttctttcattgaatgaaagcattactgctcttcagaactagttaggagacac

SEQ ID NO: 43785 - DNA, 449 bp, Homo sapiens
  misc_feature 7: n = A,T,C or G
gatcctncacctactttataattggtttatctttttaatattgaactgtaatagtttttaaaaaatatatcctaaatacaagtctcttatcagataatatgatttgcagatattttctgtcattctatgtactgtcttttcacattcttgatgatagacttttcagcccaaatgtttttaacttgatggaatacaatttattttttcttttgttgcttgtgctttcagtcatatttgtgaaaactttgcttatcccacattaacaaagatttactatttctaagtgatttataattttaccacctacctttaggtctctgatccattttgagttaatttttatgtgcgaggagggagtctaacttgattcttttacatgtggatatttaagttgtcccaggaccatttgttgaattaagtgcccagaacaagtacatctatatatagag

SEQ ID NO: 43786 - DNA, 132 bp, Homo sapiens
ataatcccagctactcaggaggctgaggcaggagaatcgcttgaacctgggaggcggaggttgcagtgagccgagattacaccattgcactccagcctgggtgacaagagcaaaaccccacctcaaaaaagg

SEQ ID NO: 43787 - DNA, 128 bp, Homo sapiens
cgtcgatgaagaacgcagctagctgcgagaattaatgtgaattgcaggacacattgatcatcgacacttcgaacgcacttgcggccccgggttcctcccggggctacgcctgtctgagcgtcgcttcc

SEQ ID NO: 43788 - DNA, 149 bp, Homo sapiens
  misc_feature 27: n = A,T,C or G
taaaagaagaaagtgttttatatacgncacttatttaatatccctttttaattagaaattaaaacagttaatttaattaaagagtagggttttttttcagtattcttggttaatatttaatttcaactatttatgagatgtatcttttg

SEQ ID NO: 43789 - DNA, 426 bp, Homo sapiens
  misc_feature 7, 32, 34: n = A,T,C or G
tgcagtncctcaagcctgtaatccgagccctntnggaggccgaggtaggtggatcacttgagcccaggagttcaagatcaacttgggcaacatggtgggaccccatctctattttaaaaaacaaaaaaataagaaaacaatggctgggcgtggtggctcacacctgtaatcccagcactttgggaggccgaggtgggtggatcatctgaggtcagaggtttgaaaccaacctggtcaacatggtgaaaccctgtctctactaaaaatgcaaaattagccgggcatggtggcacatgcctgtaatcccagctacttgggaggctgaggcaggagaatcgcttgaacctgggaggcagaggttgcagtgagccgaaatcgtgccattgcactccagcctgggcaataagagtaaaactccatcccgaa

SEQ ID NO: 43790 - DNA, 490 bp, Homo sapiens
  misc_feature 2, 18, 19, 70, 146: n = A,T,C or G
tntggccggggattaccnncgtgagccaccgcacctggcccttttttggctttttaaatggatagctctngtaaaatctaatatgatgcttagacattctttatacatacaaatggtctaagcttctaatttctgtaagtaatcangacctccgctttctataccacagaatgagctgtgaggaactccattttctccatctctgtccctcagccactctgctacaccctagcagttctggaggcatcccacggacccaaggttccccaaacaccatttgtaaataactcatactgaatagtccaatcccctcattctacaaagaagcaaactggggctgaggatatgatgagttatccaaactcacagagttaagtcagtggctaagttaggaacagaactctgtgtttgggatccatgtaagtattctttcagcttaccatacactgctgaaggaggtaggactattttcagtttctaaatgtctgca

SEQ ID NO: 43791 - DNA, 421 bp, Homo sapiens
  misc_feature 24: n = A,T,C or G
gagggggcaggcggagcttgaggnaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 43792 - DNA, 131 bp, Homo sapiens
  misc_feature 25: n = A,T,C or G
cagttccttcaataataaatatgtnttagtaaaaatggatatccagatgcagaagaatgaaattggacccttatctcataccatatgtgaaaatcaaatgaaaatagattaagaacttaaatgtaacaccc

SEQ ID NO: 43793 - DNA, 444 bp, Homo sapiens
tatttttaggcagttgggtaaaactgaccaatttagttttaagaaactgactgtggctccagagtatgttggagaagtgaaaatggagactaggaataacaggtgggagactattagtctaattaagatgtaattataaatctaagctaggaacgtaaaatgagaatgcaaagtaagaaacaaatatggggaaaattatatgtaaaagtaataggacttggcatcttactgatgtgattgattatgagaaaaatgaagcatgtggaggagtccactggacagtaggaaattcagcctaagacttgggtaagagttctgtggagttgtgaattcagaggccagagatgtgatatttaaaattttggttcaagatttcccaggtataagaaagcaagaggattaaagcattgtaattaaactttaagcagtgcatatttatgttat

SEQ ID NO: 43794 - DNA, 354 bp, Homo sapiens
  misc_feature 7, 15, 32: n = A,T,C or G
atcctcnctaatttnaaaactaccgttctttnttggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactct

SEQ ID NO: 43795 - DNA, 158 bp, Homo sapiens
gagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttg

SEQ ID NO: 43796 - DNA, 348 bp, Homo sapiens
  misc_feature 4: n = A,T,C or G
tgtnttccaaatatgagatgcgtcgttacaggaagtcccttgccatcctaaaagccaccccacttctctctaaggagaatggcccagtcctctcccaagtccacacaggggaggtgatagcattgctttcgtgtaaattatgtaatacaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctta

SEQ ID NO: 43797 - DNA, 371 bp, Homo sapiens
tcattgctgtggagaagaagaaggcagggctgttggatgaagggtcaggaacctcaagatcagtaaggggctaaattttgggtcctctgagaaaatgttgccatctgggcaatatgatatctattttgggatcgctgggaaaggactcgggtcagtgatctcagtgttgcctttagatcctctaggttgttcagggcctcagcatccatgacaagtgacagtggctcagctctattagcaaagaactgaccaacttgttgatctatattcacctgtttgccttttgtgtctgtgcagttgacattggttggaagtgatgtggaacaagcatcctgtagttttccactgtacccagtctgcctaaatttaat

SEQ ID NO: 43798 - DNA, 342 bp, Homo sapiens
  misc_feature 3, 33: n = A,T,C or G
canaactccaaggagctgctgacccgggagctntttagcttcttggggaaaaggacagatgaagctgctttccagaagctgatgagcaacttggacagcaacagggacaacgaggtggacttccaagagtactgtgtcttcctgtcctgatcgccatgatgtgtaacgaattctttgaaggcttcccagataagcagcccaggaagaaatgaaaactcctctgatgtggttggggggtctgccagctggggccctccctgtcgccagtgggcactttttttttccaccctggctccttcagacacgtgcttgatgctgagcaagttcaataaagattcttgg

SEQ ID NO: 43799 - DNA, 410 bp, Homo sapiens
aggatatctctaagtttgctatgccttatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatga

SEQ ID NO: 43800 - DNA, 482 bp, Homo sapiens
tatggccgggggggagccagtccacttaaatgcagctccaggtttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggt

SEQ ID NO: 43801 - DNA, 419 bp, Homo sapiens
tatggccgggcaataaccactatagtatttaataaatattgcttttaaagtgcctcaagaacatggctcaaaaaaggcacaccttgcactaggaaatacttgtacatttgtattaacttgtgctttgtgttccatttctgttaaggtctatcttttcatcttcttttgtgtggccaaaaaaccacgatatctgttaaaaagaaaaataaatttagtttggatgaaggagtcttatttgaattgtttatacacaagtaattctactgataatttagtgttcccatttgtgatttttttcagttctatgatgaagcaaatgattacaaatagttcagatattctctagcccaacagtagagcatgtttaagatagttaataggatacagttttctaggatctctttatatagatctgatac

SEQ ID NO: 43802 - DNA, 442 bp, Homo sapiens
gattaaaccgaaggtgattaaaacaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttaga

SEQ ID NO: 43803 - DNA, 248 bp, Homo sapiens
  misc_feature 24: n = A,T,C or G
gcacaaaatgatgcccgttttttnctctcatgaaagtcttaggttgtaagatttctcttgtatgagctggtgtggggcaaccagtgttttgaggattgacttttattattctatcaatgtgtgaaaatgtctgattaatttcatgtcatctcaagtataacgtgtcaagagcacaattattttacaaacaagagacttattagaccaaggaatttttttctatgttgtttaagcttttatgattgcac

SEQ ID NO: 43804 - DNA, 264 bp, Homo sapiens
aggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattccgcaagccacaacagttaaaaacaaggatatcaggaaatttttggatggtatctat

SEQ ID NO: 43805 - DNA, 226 bp, Homo sapiens
  misc_feature 33: n = A,T,C or G
attgtcttcctgtaagaccttcgggtcaaggtngaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 43806 - DNA, 263 bp, Homo sapiens
aatagtcctcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactt

SEQ ID NO: 43807 - DNA, 330 bp, Homo sapiens
  misc_feature 25: n = A,T,C or G
aataagtctgaataccccatattcntactcctaatctcattatatcttattctagtgaattttatttatgaataatttctgttgaagtgaaaactagatatttaatattttgcttttttgctacatagtctactcaaaaattacatgaggagaaatcctttttccctttgtttttcttttttcttcttttgtggtatttaaagcatattttaggttgaagttacttatttctagtcttgtacttctggcttaagtataaccatgtaagaattataaattttagttttctgaacccttaaacttttttagcatgtggtctgttacacatgc

SEQ ID NO: 43808 - DNA, 374 bp, Homo sapiens
  misc_feature 6, 29, 55: n = A,T,C or G
gggggncctgcccaagtcagacagccgcntagaggagagccagggctcatctgcnggccatctccatatgctggacttggagaacagggcaggactacaagttctgtcccttgtaggccatgtggagtcagccaggtgcccagccagacaacattgcccttgtctcaaggagttgctttcctctcctaccaggttcttctaccccaaagttcagaggccagaggtgggaactcaatgccttcagaaggtgccctggctggacgccatggctcacacctgtaatcccaacactttgggaggccaaggcaggcagatcgcttgagcccaggagttcgagaccagcttgggcaacatggagaaaccccatctttacc

SEQ ID NO: 43809 - DNA, 237 bp, Homo sapiens
acatctggtagaattcagcagtgaatgtgtctggtcacgggctttttttgggtggtaggctatttattactgactcaatttcagagcatgttattggtctgttcagggaatcagttttttcctggttcagttttaggagggtgtatgtgaccagaaatttatccatttcttttagatttcctaggttatatgcataaaggtgttcataatattttcttatgattgtttgtgtttctg

SEQ ID NO: 43810 - DNA, 167 bp, Homo sapiens
gttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagca

SEQ ID NO: 43811 - DNA, 172 bp, Homo sapiens
  misc_feature 24: n = A,T,C or G
actgggttttgctacattgccganggtggtcttgaacccctgggctcaagccatcctcctgcctcagccccgagtggctaggactacagttgtgtactgctgcatctggctaattattttatttttttgtagaggtgaggtcttgctacattttccagtctggtggatttac

SEQ ID NO: 43812 - DNA, 363 bp, Homo sapiens
  misc_feature 41: n = A,T,C or G
tatggccggggacctccttcatttctaccggtctctagtantgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaaga

SEQ ID NO: 43813 - DNA, 414 bp, Homo sapiens
  misc_feature 8, 189: n = A,T,C or G
aaagaaanctagtatttcccaaatgtatttgaccttaagactttttcccctcctaatacctattaccgtctcacagattgaatgttcagtgaataggctttgaggaacacttaactatttttatggtcatttcattcttctgctgggaagatgctctaaggataagctgaaaaaactgatgacgatcangaaaaaaaaatttcacttctgtgaggcgattgtgtttaaaactatcaaaaggtttctcatcacagatgagtagtgaaggaagccattctttcctatggtgagcaggtttaggaaatataggcagcgagggttttctggaagctggtagttcacagggctcagaaggagacataatgcttctctgtggaagtctcgaccaactagttgtggtcctttgatgtcaga

SEQ ID NO: 43814 - DNA, 407 bp, Homo sapiens
  misc_feature 24: n = A,T,C or G
gttctatttgaaagtttttcattnatttttcctttttatttatgtatttattgtttgagacagtcactctgtcgcccaggctgaagtgcagtgatgtgacctggactcattgcaacctctgcctcccgggttcaagcaattcttgtgcctcagcctcctgaggtagctgggattacaggtgcgtgtcaccacacccggctaatttttgtaattttagtagagacggtttcgccatgttggccaggctggtctcaaactcctgacctcaagcagtccacccgcctcagcctcccaaagtgttgggattacaggcgtgagccaccgtgccggcctgtttttcttttttaaaaaagacctattagagctgtagaaattctcggtaggaagaaatacaaataaagatatat

SEQ ID NO: 43815 - DNA, 241 bp, Homo sapiens
  misc_feature 18, 24, 68: n = A,T,C or G
cttctttcccagggaatncggctnttttggccggggaggttgcctggaagtaccaggcagtgacagcnccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcct

SEQ ID NO: 43816 - DNA, 477 bp, Homo sapiens
ggaaaccgtgggttgcaattgttacgagtggtttgtaggaagcttctaagttaatgatactgtattatgtagtgcatttaggttgaaagcctaaaataatataatattgagtcattctagcatatgttctttaacattatgagatagtacattagttgagttccctttgatttttgataaattattttaaaataacctcataaaaattttagcactgttctatcctctctttttaaattacaatttatagaaagatgatgagctattttaatccattctagtcactttgtaaacaaaattagaaggctttatattcatgaattaataataacatgagaacggtggtgactatgcattgcttacaaagctattcacattcattttcatataatagaaaaatcaaccttaggtcagcccgatcgagcataatatgcagggttttctcttttaaaatatggcaacaataaattgaaactg

SEQ ID NO: 43817 - DNA, 455 bp, Homo sapiens
  misc_feature 32: n = A,T,C or G
gagagccgaggtggtggcggcggaggcttttncagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcaga

SEQ ID NO: 43818 - DNA, 489 bp, Homo sapiens
  misc_feature 2, 17, 18, 45: n = A,T,C or G
tntggccgggctgtggnncaatagttaaaagaatgttcccaaccnaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtgggtggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacag

SEQ ID NO: 43819 - DNA, 327 bp, Homo sapiens
  misc_feature 23: n = A,T,C or G
gaacttctgtgcataccttatanttcataatgtctgacaatttaaatggctcatgtattcttgcttctatcataagctgattatggggactatgatcttttgtatacagcaaattttaaactgtagcacaaacatctgtttatgtattggtggaatatacctgttttatttatcttttttgaggtaaactaatttttgatacttttcattactgtgtactatgttcatactttgaattctctgacgttagaagtcatggttgagaattgtaacagctgttattcgttctgtattcatggctttcactgctgaataaaataaaggacc

SEQ ID NO: 43820 - DNA, 367 bp, Homo sapiens
  misc_feature 7, 8, 33: n = A,T,C or G
attatgnnattgctgtaaacaaaattcttcttntattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaagaaactgtgataactggggcgttgttttttaaaataaactccagcacagggatactgtgcatgcctgagttgattccgaagtgcatatgtctgtaaggatttggagtgcctgcagtgttttatgtgtgggaagtaagggtgagtctcatattcttctattaaatttgccacaagaattgc

SEQ ID NO: 43821 - DNA, 486 bp, Homo sapiens
  misc_feature 1, 31, 32, 33: n = A,T,C or G
nacccgccaaatacttcgacaaacttccaannnttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaag

SEQ ID NO: 43822 - DNA, 231 bp, Homo sapiens
  misc_feature 2, 4: n = A,T,C or G
tncntttctctttggtttgttgaagtttttttgcacattcccttaagtttggcagtctaatctgtatctttggcataaatattttaaaacaaaaaatgctggccaagtgtggtggctcaggcctataatcccagaacttgggaggctgaggtgggagtattgcttgagctcaggagtttgagaccagtcggggcaatatggtgggacctcatctccacaaaaagaagaaac

SEQ ID NO: 43823 - DNA, 490 bp, Homo sapiens
  misc_feature 18, 41, 42, 43, 44, 69: n = A,T,C or G
tatggccggggacagccntggcgggcgcgttggtgcggaannnngcggactatgtccgaagcaaggatntccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctg

SEQ ID NO: 43824 - DNA, 484 bp, Homo sapiens
  misc_feature 4: n = A,T,C or G
cacncgcccgtattcaccccacacccagggctatttttaaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttgaggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtg

SEQ ID NO: 43825 - DNA, 468 bp, Homo sapiens
  misc_feature 34: n = A,T,C or G
ggcgcactcgatatagtaccgcaagggaaagatntaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 43826 - DNA, 111 bp, Homo sapiens
  misc_feature 24: n = A,T,C or G
caggttcttgggagcgtgaggcangaagacactaggtgctgaatctcctgcaaaactggctgcctggaggccctgagccacccagatctgaataaaacagatgcttacccc

SEQ ID NO: 43827 - DNA, 126 bp, Homo sapiens
  misc_feature 7, 33: n = A,T,C or G
aacatancagtgaactgtaatgttgggaccagntgtgacagctcatgcctcagaagtcgagggttcagtgtgctgtgattgcaccaatgcactccagcttaggtgacacagtgagactctgtcccg

SEQ ID NO: 43828 - DNA, 311 bp, Homo sapiens
  misc_feature 17, 30, 45, 152: n = A,T,C or G
tatggccgggggaccanctggagattatcntggccatggaagtangaatttgggtttgaaattcctgatatagatgctgaaaagttaatgtgtccacaagaaattgtagattacattgcagataagaaggatgtatatgaataaagtatcangaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaatc

SEQ ID NO: 43829 - DNA, 492 bp, Homo sapiens
  misc_feature 4, 9, 32, 35: n = A,T,C or G
gctntctcncaagatggcgccgaaagcgaagnttntagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgccgaccactgagtctgccatgaagaagatagaagacaacaacacacttgtgttcatttgtggatgttaaagccaacaagcaccagattaaacaggctgtgaagaagctgtatgacattgatgtggccaaggtcaacaccctgattcggcctgatggagagaaagaaggcatatgttcgactggctcctgattacgatgctttggatgttgccaacaaaattgggatcatctaaactgag

SEQ ID NO: 43830 - DNA, 430 bp, Homo sapiens
  misc_feature 7, 31, 32, 60, 430: n = A,T,C or G
gagctcnctattgacaggtttcgtctaaggnntttaaacatggaagaatcctggcactgnctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggn

SEQ ID NO: 43831 - DNA, 480 bp, Homo sapiens
  misc_feature 8, 35: n = A,T,C or G
gagaactncttccggactccaggtaccgcgcttgncggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttcccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatt

SEQ ID NO: 43832 - DNA, 439 bp, Homo sapiens
  misc_feature 10, 30, 32, 42, 46, 71, 78, 105, 110, 142, 163: n = A,T,C or G
acccttagcntaacctttacccaaattttntntaggcgatanaaantgaaacctggcgcagtagtatatantaccgcnagggatagatgaaaaattataaccaancatantatagcaaggactgacccctataccttctgcntaatgaattaactagaaatanctttgcaaggagagccaaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagcttcttttggacactaggaaaaaaccttgtagaga

SEQ ID NO: 43833 - DNA, 379 bp, Homo sapiens
  misc_feature 16, 180, 228, 257, 327, 337, 338, 363, 372: n = A,T,C or G
gtccatagctagtggncttgcacctttgcacatagagatatttgggacccaagggaaaccagccattgcccatcgagatttaaagagcaaaaatattctggttaagaagaatggacagtgttgcatagcagatttgggcctggcagtcatgtattcccagagcaccaatcagcttgatgnggggaacaatccccgtgtgggcaccaagcgctacatggcccccgaagntctagatgaaaccatccaggtggattgtntcgattcttataaaagggtcgatatttgggcctttggacttgttttgtgggaagtggccaggcggatggngagcaatggnntagtggaggattacaagccaccganctacgatgngggtccc

SEQ ID NO: 43834 - DNA, 100 bp, Homo sapiens
  misc_feature 48: n = A,T,C or G
ctaattgccatgtacagtatgtttaaagtcaaataactcctcattgtnaacaaactgtgtaactgcccaaagcagcacttataaatcagcctaacataag

SEQ ID NO: 43835 - DNA, 498 bp, Homo sapiens
  misc_feature 2, 21, 224, 480: n = A,T,C or G
tnctttggccggggagaaccncccgcagccccgaggctcccgctttttccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggnggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccngggcagagggcaatagca

SEQ ID NO: 43836 - DNA, 463 bp, Homo sapiens
  misc_feature 15, 41: n = A,T,C or G
gaagaattccccagnagcaggaaggaatcttttcttttctnagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaattaattatcagacatatcatcacctccagtgga

SEQ ID NO: 43837 - DNA, 438 bp, Homo sapiens
  misc_feature 23, 33, 34, 360: n = A,T,C or G
attttaccgaagtgattctaagnatttggtttnntatcaataggaaagcatatgcagcccaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgttttaataaaagatttacat

SEQ ID NO: 43838 - DNA, 469 bp, Homo sapiens
  misc_feature 6, 7, 32, 60, 391: n = A,T,C or G
gaagcnnccttctggagtaaaaaatgtatttntttagaaaattgagagaaaggactacanagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatngagaagatagggaaattagaagataaaaacatacttttagaagaaaaaagataaatttaaacctgaaaagtaggaagc

SEQ ID NO: 43839 - DNA, 120 bp, Homo sapiens
  misc_feature 43: n = A,T,C or G
ttgaagttgacttactgaagaatggagagagaattgaaaaagnggagcattcagacttgtctttcagcaaggactggtctttctatctcttgtactacactgaattcacccccactgaaa

SEQ ID NO: 43840 - DNA, 280 bp, Homo sapiens
  misc_feature 8, 280: n = A,T,C or G
cgtggacncctcatgtctgtaatcccagcacttttggaggccgaggcagacggatcacctggggtcaggagtttgacagcagcctgaccaacatggcgaaacctcatctctactaaaaattcaaaaaattagccgggcatggtggcgggtgcctgtaattccagctacttgggaggctgaggcaggagaatcgcttgaacccgggacatgaaggttgcagtgagccaagatcgcaacactgcactccagcctgggaaacaagagtgaaactccgtcgcgn

SEQ ID NO: 43841 - DNA, 457 bp, Homo sapiens
  misc_feature 32, 35: n = A,T,C or G
atagtcccgcaagggaaagatgaaaaattatnttncaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 43842 - DNA, 487 bp, Homo sapiens
  misc_feature 7, 8, 21, 32, 34, 60: n = A,T,C or G
caccccnngaaaagccccagnattggaggtcntnttcatgatgataatattcatgacctnatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctgggttgtcctaaggccatagt

SEQ ID NO: 43843 - DNA, 444 bp, Homo sapiens
tctggagctgtggtcgctgccgtgatgtggaggaggaagagctcagatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgag

SEQ ID NO: 43844 - DNA, 498 bp, Homo sapiens
  misc_feature 2, 5, 30: n = A,T,C or G
antanaaacaaggtcactggaatcaactcntgggctggcatcatttcaccatgtatttcttctttgggctgttgggtgtggcagatatcttacgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgagggatcatgaaaatatttttgtttctcaccatatgcttttgttggcattatgcagtaaccattgtcatcgttggaatgaattatgctttcattacctgggtg

SEQ ID NO: 43845 - DNA, 362 bp, Homo sapiens
  misc_feature 59: n = A,T,C or G
attgccccttgatggaagctggttgatgccttttagccagtttgccatccctgcactanagctcagggaatataaagggacagaatggagggaaaaaaactggaaaggaaaatggacaagatcgttggaatctcaaatgatggctaactctttttacagagcttttaacttgatcacatttcaggggcccagttgtggaactgacatagagatagatacccataagttagctgggttccctaaatattaaagagctgacttatggtgtttttagtttgcttcatttctatttataaaatgggggcactaaaggcattcaatttatagaactgtaaagattcaataaagttatggtgtgtcat

SEQ ID NO: 43846 - DNA, 203 bp, Homo sapiens
  misc_feature 8, 33: n = A,T,C or G
caaagaancggggcttcaccaagttcaatgctntttgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtccc

SEQ ID NO: 43847 - DNA, 291 bp, Homo sapiens
  misc_feature 7: n = A,T,C or G
caagctnccgtggatcctgagaacttcaggcttctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgc

SEQ ID NO: 43848 - DNA, 443 bp, Homo sapiens
  misc_feature 3, 8, 48, 49, 72, 73: n = A,T,C or G
ctntggcncggggatgaaccccgaatgatgaaatgaaatgatgatccnntgaaatgaaatgaggaaatgaanncgaagaaatgaaatgaagtgaaatgatgaaatgaaatgaaatgatgaaatgaaaagatcaaatgatgaaatgaagaaatgatatgaaatgaagaagtgaaatgattaatgaaataatgaaatgatgaattgatgaaatgaaatgatgagatgaaaagatgaaatgaaatgatgaaatgagatgaaaagatgaaatggaaatgagatgaaatgaaatcatgagatgaaatgaaatcatgagatgaaatgatgaaatggaatgatgaaatgaaatgatgaaatggtgaaatgaaatgaggaaatgaaatgaagaaatgaaatgaagtgaaatgatgaaatgaaatgaaatgatgaaatgaaaagatcaaatg

SEQ ID NO: 43849 - DNA, 465 bp, Homo sapiens
  misc_feature 34, 35: n = A,T,C or G
ggaaacgccaagtgagcggcggggtcgactgacnntaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcagggcagtgcagcaggttcagcgtcttccatttctttcaagctcaaatctttcactggatgttttgaggggtaatgatgagactattggatttgaggatattcttaatgatccatcacaaagcgaagtcatgggagagccacac

SEQ ID NO: 43850 - DNA, 289 bp, Homo sapiens
cagcaagcataaaaaagaaatccatatcttaaagtaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggttctgcttcaataaatctttggaaaaactc

SEQ ID NO: 43851 - DNA, 154 bp, Homo sapiens
atatgccaccaagattggttccagtacaccctgtgtatacctaaatccacagatgccagctcttttataaaatggaatattcgcatgtacctacccacattctcctgtatactctataaatgtctagattaattaaaatatctcatgcgttgtg

SEQ ID NO: 43852 - DNA, 346 bp, Homo sapiens
  misc_feature 7: n = A,T,C or G
aactccnctttcactaatatagtttaaggctttttcactgaattgccagagctgacaaacaattttagtacaatgccattgacagtgtctgggtagggcatttgtgaaagctctgaaggagaagtctcagaagtaaaatataattatgacagaggaaagagctttctcctgatgtaaaagtatcaatgtctgcactggctatgccttgctacctccagaggggtgaagtttttgtaccaattcacacaccacatcccatgccaacatggttccatgttgatatgctcatatagataagatcccgttaaaattaatgccaagaggaccttcaaagggaacatcagga

SEQ ID NO: 43853 - DNA, 432 bp, Homo sapiens
  misc_feature 4, 7, 33, 37: n = A,T,C or G
agancangcagtagctatacttacataagacantttngatttcaagacaaaaactataagcaagagacaaagaatgtcactatatggtaataaaggggtcaatttagccaaaagatataacaactgtaaatatatatgcacccaacactagagcacccagaaatatcaagcaaatattgttagagctaaagagagagatagatcccaatacaataatagctggagacttcagcatcccactttcagcattgtacagatcttccagacagaaaatcaacataggacctaatctgcactatagactaaatagacctaataaatatttacaggacacttcatccaacagctgcagaatacatattcttctcctcagcatgtggattattctcaaggatagaccacatgttaggtcacacaaatctgaaagtattc

SEQ ID NO: 43854 - DNA, 265 bp, Homo sapiens
  misc_feature 7, 33, 36: n = A,T,C or G
ggacatncgaagggcccgagcaggaattcggtntgnacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgtt

SEQ ID NO: 43855 - DNA, 461 bp, Homo sapiens
  misc_feature 18, 44, 90: n = A,T,C or G
tatggccgggattgctanaaaataaataaaagctagatactggnaacctaactgcaatgtggatgttttacccacatgacttattatgcntaaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgg

SEQ ID NO: 43856 - DNA, 419 bp, Homo sapiens
atggccgggattccagcagcatctcagtaaaccccagccaaactttcccagtccagaatacatgatatttgatcatgagtttacgaagctggtaaaagaacttgaaggtaagactgaagatttatattgatatttgatggaaagtaattatatttatattgtacatgtatattctggatgcatacaggttatatggtaactctaaaggtatattttcttcctagctcttgatctgtagcccattgaaggacatttggctttcagtaggattgaaaagattatttcttacctatcatggagttaggttatatggtttttactaagtcttagtagtaaaatagtatttaaaacatttaaaacaaattttaaataagcttccttttataggtgttataactaaggctatttataagtccaac

SEQ ID NO: 43857 - DNA, 211 bp, Homo sapiens
  misc_feature 43, 46: n = A,T,C or G
tatggccgggggggacccctttggccccacaagggacatgtgnttntaactgagaacattattggttgtcaaagggggttatgactggaatctactgggtagaggtcagggatgctgctgatgtcctacaacgtccacaagacagcaccccacaggaaagaatgatgcaccctaaaatgtgtgtggtgtcagcctggagaaaccaccttag

SEQ ID NO: 43858 - DNA, 179 bp, Homo sapiens
aaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtt

SEQ ID NO: 43859 - DNA, 494 bp, Homo sapiens
  misc_feature 4, 9, 30: n = A,T,C or G
aacnccggnccttttggccggggaagatcncgattaatacaactacttaaaaaatttgtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatggagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgg

SEQ ID NO: 43860 - DNA, 234 bp, Homo sapiens
  misc_feature 25, 112, 181, 226: n = A,T,C or G
aatcttttaatgcataaaccgaatnagggtccagttggcctgttaatggtaaatttacattttaaatgactcagtttgtttttcctgggcgagtttgcaatgtgataatcangattttttaaaactgattaatttgctttcttgtgtgggtgtactcacattttaaagtatgaaccacagntaactagtggtctcaggggtagtgaaacactcacttttttttttngttggttt

SEQ ID NO: 43861 - DNA, 154 bp, Homo sapiens
  misc_feature 149, 151: n = A,T,C or G
ggcatttaatatcttgtcattttattccttctgtttaaaaatcttcaattaatacctaccaccagtcaaatgaagtctaaaagtagccttccctcattaggagtcaaacttcacaacttaatttctgcttcttcctgctgcctgtgctngnaga

SEQ ID NO: 43862 - DNA, 434 bp, Homo sapiens
  misc_feature 19: n = A,T,C or G
gtgttgagagcttctcagnactatccacctttgggtcgctttgctgttcgtgatatgagacagacagttacggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcggtactttttaatggaaacaacttgaccaaaaatttgtcacagaattttgagacccat

SEQ ID NO: 43863 - DNA, 349 bp, Homo sapiens
  misc_feature 1, 8: n = A,T,C or G
natctctnaaaatagtgtggagatttctcaaacttctaaaagtagatctagtccaggtgcagtggctcacgcctgtaatcctagcattttgggaggccgaggcgggaggattgcttgatccctggagttcccgactagcctgggcaacatggtgagaccatgtcaatacaaacaaataagtaaaatattggccgcaggagttgccagcctgtggtcccagctaggagatgagctgtggtctcaggaggctgaggtgggaggattgcttgagttcaggaggtagaggctgcactgagccattttcatgccactgcactccagcctcagtgacagactgagtccttgtctc

SEQ ID NO: 43864 - DNA, 477 bp, Homo sapiens
  misc_feature 445: n = A,T,C or G
tgaagaagtttggaggctgcccagcagcagtagactggccaactgcagagcaagttgtttctccagccgtgcggtgcagcctcatgcccccaacccagcttagccactgtaagaagacgttcacttgtacagacgaccaaacttgccgtggaagagacagttgtgagattcccttgcaaatttacatacgagaatggcttgtgaaatcatgcctctgcaaaggtagtattttcctattttattttattctgctatgtattttttgagttgtatcaagccatataactttgccagtacttggcatcttttagtaacatgctgcaaagtgtgtagagtccgttgtacatatggttcctccctaagaacagaaaaaattaaatattatactgctcttttactgacattttgcccaacttatctttttcacttgattgttgtatttagntatatccttctctgaatggaaatgaatataag

SEQ ID NO: 43865 - DNA, 376 bp, Homo sapiens
  misc_feature 8, 60, 215: n = A,T,C or G
aagtgtcnccagctgggagccagccggcaggtttttgtgagttggcgtgctagtgggacnggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagncagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactacg

SEQ ID NO: 43866 - DNA, 461 bp, Homo sapiens
caggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgct

SEQ ID NO: 43867 - DNA, 470 bp, Homo sapiens
  misc_feature 52: n = A,T,C or G
gaggcattgaggcagccagcgcaggggcttctgctgagggggcaggcggagnttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaagg

SEQ ID NO: 43868 - DNA, 364 bp, Homo sapiens
gctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacctggagtgccaaggctaaaagacgaaataccaccggaactggtcgaatgaggcacctaaaaattgtataccgcagattcaggcatggattccgtgaaggaacaacacctaaacccaagagggcagcctgttgcagcatccagttcatcttaagaatgtcaacgattagtcatgcaataaatgttctggtttt

SEQ ID NO: 43869 - DNA, 290 bp, Homo sapiens
atacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagccga

SEQ ID NO: 43870 - DNA, 209 bp, Homo sapiens
atttcttgaagtgccattttgatactttcagtgttctgaactgtacctagaacgtactttttataaaaaggaagcagagtccatccaggcagagagagtactgtgtgcctgtagtcttgtctattcgcaaggctgaggccagaggatcccttgagcccaggagttcaagtccaggctgggcaacacactgggaccatgtttcctaagcc

SEQ ID NO: 43871 - DNA, 467 bp, Homo sapiens
  misc_feature 110: n = A,T,C or G
atgtaaaattagaattgtaattaaaaatacacattttattatgtaatcatgttctggtatgtctcatttctcagccttattttataacgtggaagtcattgaactatgtnatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaatttttttgctttatgttttgacctttataaaggtgttattctgctgcccagttttgtaattctcaaaaatagtgccaggtcttcta

SEQ ID NO: 43872 - DNA, 460 bp, Homo sapiens
  misc_feature 42: n = A,T,C or G
attcttcccggggagaccgcagcccatcggcatggctcaagnagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcttagttggtctttggtgtcatatggatcaga

SEQ ID NO: 43873 - DNA, 468 bp, Homo sapiens
caggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctggggttgcagactggtctgaaggtgtacaggtgccctctgtgccctattcagcaattccctactgaagactggag

SEQ ID NO: 43874 - DNA, 470 bp, Homo sapiens
  misc_feature 28, 173, 331, 411, 416, 468: n = A,T,C or G
atcaaaataccaacattagtagcccagnaattagaaaatcctaaaatttatatgaaatgaaaaaagagccagaataaccaaaacaatcaaaagcgataagtacaaatctggaggcatcacattatctgacttcaagttgtgttacaaggctatagttaccaaaacagaatggnactggtataaaaatagagtcatagaacaatggaacagaatagataatggagaaataaagccaaatacatacaaccaattgatctctgacaaagcatatgaaaacacaaattggagaagggacgctccatttaataaatggtgctgggataactggcangccacacatagaagaataaaactgtatccttatttctcaccatataaaaaaatttaagatggatcaaagacttaaatgtnagggnttgaaaccataaaatttctagaagacaatgttagaaaaactattttagatgnca

SEQ ID NO: 43875 - DNA, 454 bp, Homo sapiens
  misc_feature 16: n = A,T,C or G
gtttatagcatttatnaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgcacctgtgattatagtacttcacttttttcctttggattaattggttaaatgaatgagaaatgtgttatgttttttactaaaaagtataaattaaaattttga

SEQ ID NO: 43876 - DNA, 294 bp, Homo sapiens
gaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactactggaagaagaaacagctcatgaggctacggaaacaggccgagaagaacgtggagaagaaaattgacaaatacacagaggtcctcaagacccacggactcctggtctgagcccaataaagactgttaattcc

SEQ ID NO: 43877 - DNA, 459 bp, Homo sapiens
cacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcag

SEQ ID NO: 43878 - DNA, 466 bp, Homo sapiens
  misc_feature 6: n = A,T,C or G
gtaccnaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgct

SEQ ID NO: 43879 - DNA, 466 bp, Homo sapiens
aggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcatttcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcgtacaccacatg

SEQ ID NO: 43880 - DNA, 383 bp, Homo sapiens
  misc_feature 2: n = A,T,C or G
angtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttataataaacattgatttgggtcgt

SEQ ID NO: 43881 - DNA, 465 bp, Homo sapiens
  misc_feature 10: n = A,T,C or G
cttcaatgtnaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaat

SEQ ID NO: 43882 - DNA, 176 bp, Homo sapiens
  misc_feature 110: n = A,T,C or G
attactgaaatacataggcttatatacaatgcttctttcctgtatattctcttgtctggctgcacccctttttcccgcccccagattgataagtaatgaaagtgcactgnagtgagggtcaaaggagagtcaacatatgtgattgttccataataaacttctggtgtgatactttc

SEQ ID NO: 43883 - DNA, 464 bp, Homo sapiens
  misc_feature 1, 86: n = A,T,C or G
natctcagataatgactgataccatgagaacgtgagctgtccaaggaaacaacgtataaggcactacttattttgctcatcctggntgatttggtgccaaaacaacaggcggaagggtgaaaaattctattagtcagctggttgtctgaactgctcaatgttagccaagcagtttgacagatctttccactgtgtcgaagtctgagctgactgctctggcattttgacagataatttctgataaattctgtgtgtgtgcattaaatggaaagaaattgtcttggatttagcattccagggtactagtttctaggccccagtgtcacccaggacctcctgaggccttttcaggggtaatgcatgcttaggtttgctcctggagaggtcactcggatgtaacgaagggtctggccaacccctaggctatttggtaacaactggagccattccagcatcttcagaga

SEQ ID NO: 43884 - DNA, 267 bp, Homo sapiens
  misc_feature 17, 21, 266: n = A,T,C or G
ataatagaaatcctganaacnaaatttgcaacttaaggtgggctccgtacttcacagagctgtatttttgtttgctatttgccatgtgcactttttgtttccttttacaaactcttttgttatattgctgtaggttttggaagttcttctacttatgttgggggccttggtttttagctttttacatgttttgttagtaatatagtttgtacttttgtttctttatttacttgatactttcaatgatgacatactgtctctgtcant

SEQ ID NO: 43885 - DNA, 465 bp, Homo sapiens
  misc_feature 330: n = A,T,C or G
tacaaaggggtcaccaatcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatctataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtnggtgggaaccaagaagcgggtgctcaccctccgcaagtccttgctggtgcagacgaagcggcgggctctggagaaagattgaccttaagttcattgacaccacctccaagtttggccatggccgcttccagacca

SEQ ID NO: 43886 - DNA, 276 bp, Homo sapiens
  misc_feature 13: n = A,T,C or G
tatggtggcttgnacctgtaatcccagcactttgggaggctgaggcgggcagatcacgaggtcaggagatcgggacaatcctggccaacacggtgagacctcgtctctactaaagatataaaaagttagccgggtgtggtggcacgcgtctgtaatcccagctactcgggaggctgaggcaggagaattgcttgaacccgggaggcggaggttgcagtgagtcgagatcacgccattgcactccagtctgggtgtcaagagtgagactctgtccca

SEQ ID NO: 43887 - DNA, 176 bp, Homo sapiens
  misc_feature 3, 20, 140: n = A,T,C or G
ganctcttagtcggtggatnactcggctcgtgcgtcgatgaagaacgcagctagctgcgagaattaatgtgaattgcaggacacattgatcatcgacacttcgaacgcacttgcggccccgggttcctcccggggctacncctgtctgagcgtcgcttgcaaaaaagaaaaaaagg

SEQ ID NO: 43888 - DNA, 134 bp, Homo sapiens
  misc_feature 12, 14, 22, 34: n = A,T,C or G
gttcccttaacnangtaaaaantcaaaatttacnaatactgttcaaattactaatttacttttgggggtggggtgttttgtttgtttgtttttgagatggagttttgcactccagcctgagcgacagaaaaaag

SEQ ID NO: 43889 - DNA, 161 bp, Homo sapiens
gtacgactcttagtcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctt

SEQ ID NO: 43890 - DNA, 206 bp, Homo sapiens
  misc_feature 13: n = A,T,C or G
gacaggatccggngctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctcta

SEQ ID NO: 43891 - DNA, 465 bp, Homo sapiens
  misc_feature 6, 34, 57, 71, 97, 108, 131, 149, 152, 176, 207: n = A,T,C or G
atgaanttattttttatgaaattcataaaattgngtgaaggaataaagctgaaactngcctttcatgtcanaagaccctatgagtttctgtgctggntcctactgggnaacactgttcttcacccaaagcngactaacttaaattcttnagntccagaataaggctttcaagatgnatttttaccatgccaaagtctgcaaaagttntggaaaaccaaaatcataatgtggaaatctgacagtcttgcactgtgatctgcttctttggagataacacgttcattgttcacttgagaaaggggataaatgtgctaattaggtagtaaacatctactctcaaattcttcccatcctttattacctttttgtctatatcctaggagacattcttttctattttttcagacctactgttaataatgggggtaatagaggctgtagattaatagcagttcacattcatgt

SEQ ID NO: 43892 - DNA, 312 bp, Homo sapiens
atctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttt

SEQ ID NO: 43893 - DNA, 464 bp, Homo sapiens
gttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttccctccagccgagcttcccagaacatcacatatcactgcaaaaatagcattgcatacatggatcaggccagtggaaatgtaaagaaggccctgaagctgatggggtc

SEQ ID NO: 43894 - DNA, 143 bp, Homo sapiens
  misc_feature 9: n = A,T,C or G
aagtaagantaggagagcagttaaataaataaactagttttaattctaagaacaatcagaaagtaatgagatattttatctttttatggcactaaatatttcctttctactttgtgtgtatgtgtgtgtgtgtgtgtgtgtgt

SEQ ID NO: 43895 - DNA, 424 bp, Homo sapiens
  misc_feature 22, 25, 44, 47, 75, 87, 88, 109, 150, 207, 322, 337, 353,381, 403, 417: n = A,T,C or G
gtatgaatttattttttatganatnctaaaattgggggaaggantanagctgaaacttgcctttcatgtcagaanaccctatgagtnnctgtgctggctcctactgggnaacactgtttttcacccaaagcagactaacttaaattcttnagttccagaataaggctttcaagatgtatttttaccatgccaaagtctgcaaaagtnttggaaaaccaaaatcataatgtggaaatctgacagtcttgcactgtgatctgcttctttggagataacacgttcattgttcacttgagaaaggggataaatgtgctaattaggnagtaaacatctactntcaaattcttgccatnctttattacctttttgtctatatcctanggagacattcttttctattttnttcagacctactgntaataat

SEQ ID NO: 43896 - DNA, 271 bp, Homo sapiens
  misc_feature 4, 271: n = A,T,C or G
agangagggtcctgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcn

SEQ ID NO: 43897 - DNA, 466 bp, Homo sapiens
  misc_feature 454: n = A,T,C or G
atctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggntttatttcagcc

SEQ ID NO: 43898 - DNA, 254 bp, Homo sapiens
gaatcataaaatccgaattttgctccacttgtcccattactgatccataaaaactggatttaatttctactgtagttatttttaaaaaatacacatttggtaccttaagaatgaaataattataggtcgggcatggtggttcaccttctgtaatcccagcaatttgggagggcgaggcagtaggatcacttgaactcaagttcaagtggagtttgagaccaggctgagcaataaagcaagactcagtctctacc

SEQ ID NO: 43899 - DNA, 489 bp, Homo sapiens
  misc_feature 381, 435, 454: n = A,T,C or G
gtatgaatttattttttatgaaattctaaaattgggtgaaggaataaagctgaaacttgcctttcatgtcagaagaccctatgagtttctgtgctggctcctactgggaaacactgtttttcacccaaagcagactaacttaaattcttcagttccagaataaggctttcaagatgtatttttaccatgccaaagtctgcaaaagttttggaaaaccaaaatcataatgtggaaatctgacagtcttgcactgtgatctgcttctttggagataacacgttcattgttcacttgagaaaggggataaatgtgctaattaggtagtaaacatctactctcaaattcttcccatcctttattacctttttgtctatatcctangagacattcttttctattttttcagacctactgttaataatggggtaataagangctggagataaatagcagntcacattcatgtggtactatcgaggggccagggac

SEQ ID NO: 43900 - DNA, 138 bp, Homo sapiens
  misc_feature 134: n = A,T,C or G
gtttgaatgtgaggcggagcggcggcaggagcgggtagtgccagctacggtccgcggctggggttccctcctccgtttctgtatccccacgagatcctatagcaatggaactcagcgatgcaaatctgcaaacnctac

SEQ ID NO: 43901 - DNA, 176 bp, Homo sapiens
  misc_feature 14, 15: n = A,T,C or G
gcattaaggtattnnttttgttattagtgaccttgacaaaaggaatttctttgaagtggtacagatagaaaccagataggactgggtgaaagtatgactgaacccagcattgccaaatttacgtgtcaaactgggcttctcctgcgtatcagggacacaggcagattcaaaataat

SEQ ID NO: 43902 - DNA, 470 bp, Homo sapiens
  misc_feature 69, 71, 131, 176, 207, 321, 439: n = A,T,C or G
atgaatttattttttatgaaattcataaaattgggtgaaggaataaagctgaaacttgcctttcatgtnanaagaccctatgagtttctgtgctggctcctactgggaaacactgtttttcacccaaagcngactaacttaaattcttcagttccagaataaggctttcaagatgnatttttaccatgccaaagtctgcaaaagttntggaaaaccaaaatcataatgtggaaatctgacagtcttgcactgtgatctgcttctttggagataacacgttcattgttcacttgagaaaggggataaatgtgctaattaggnagtaaacatctactctcaaattcttcccatcctttattacctttttgtctatatcctaggagacattcttttctattttttcagacctactgttaataatgggggtaatagaggctgnagattaatagcagttcacattcatgtgggta

SEQ ID NO: 43903 - DNA, 161 bp, Homo sapiens
  misc_feature 2, 30: n = A,T,C or G
anctgactgatgaaactggaagttaagaancgaagtaataaggccaggcgtggtggctcatgcttgtaatcccagcactttgggaggctgacgtgggaggattgcttgagcccaggagttcgagaccaggctaggcaacatagtgagactctgtttctgcg

SEQ ID NO: 43904 - DNA, 163 bp, Homo sapiens
  misc_feature 5: n = A,T,C or G
agaanaatctgcttccatcccgccgtttggtttcattgtactgacaacctcagctggcatcatggaccatgaagaagcaagacgaaaacacacaggagggaaaatcctgggattctttttctagggatgtaatacatatatttacaaataaaatgcctcatgc

SEQ ID NO: 43905 - DNA, 421 bp, Homo sapiens
  misc_feature 421: n = A,T,C or G
ctctgttttggtaccagtaccatgctgttttggttactgtagccttgtagtatagtttgaagtcaggtagcgtgatgcctccagctttgttcttttggcttagggttgacttggtgatgtgggctcttttttggttccatatgaactttaaaatagttttttccaattctgtgaagaaagtcattggtagcttgatgggggtggcattgcacacgtatgtttatggcggcactattcacaataccaaagacttggaaccaacctaaatgtccaacaatgatagactggattaagaaaatgtgacacatatacaccatggaatactatgcagccacaaaaaatgatgagttcatgtcctttgtagggatgtggatgaaactggaaatcatcattctcagtaaactattgcaaggacaaaaan

SEQ ID NO: 43906 - DNA, 465 bp, Homo sapiens
  misc_feature 4: n = A,T,C or G
agcnacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagact

SEQ ID NO: 43907 - DNA, 465 bp, Homo sapiens
tatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttggaccctttggccttggggtccatcctggagaccctgaggtctaagctacagcccctcagccaaccacagacccttctctggctcccaaaaggagttcagtcccagaggggtggtcaccccacccttcaggggatgaagaagttttcaaggggtattacttcaggcactaaccccaggaaagatgaca

SEQ ID NO: 43908 - DNA, 458 bp, Homo sapiens
aagcaaagtttgatgttacctccgtctcactctaaagcttggatttgtaaccatgaccttgtactattcttcactctctgcttataatattttttgtttctgtttttgatagagtgtcttgctttgtcacccaggctggattgcagtgttgtgaacatggctcactgcagcctccacctcccaggctcaagtgaacacctcagcccccaggaggctgggactgcaggcatgcaccaccacaccctgccaagttttgtatcttttgtagagacagggtttggttatgttccccaggctggccttgaactcctgagctcaggcaatccgcctgcctcagcactttgggaggccgagaggcaggtggatcacctgaggtcaggagttccagaccagcctggccaacatggtgaaaccccatctctagtaaaaatacaattagtcggtcgtggtgggtggtg

SEQ ID NO: 43909 - DNA, 466 bp, Homo sapiens
aatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaat

SEQ ID NO: 43910 - DNA, 149 bp, Homo sapiens
gtaaatcttattcttttgtaatatttatttatatttatttatgacagtgaacattctgattttacatgtaaaaacaagaaaagttgaagaagatatgtgaagaaaaatgtatttttcctaaatagaaataaatgatcccattttttggt

SEQ ID NO: 43911 - DNA, 465 bp, Homo sapiens
  misc_feature 440: n = A,T,C or G
gatgggagaaggtcagagtagatcttgctacgtctgctgttttctcaactgccaatctgccatatttggaggtagtgtgtcctgaacccttgccaagtgtaaacatccttttctcttggttgttatgaaaaagagattatacagccacaaatgaaaaagatgttataggaaatggcattatcatgggagcttcgggattgattcaaggagataggttgaaatactaattatgaacaaaatgtaaggtaatgtgtaaaagaacacagaatccactgtaatggagaaagaaaggtagatagataggctgtatgcatatagtgaggtacagtaaccccatccatggagagaaaatgtgaaacagagcaaggtaatggaggaaatagtaaaaggaaagaaggaggaaataagcaaggaaaggttagccaggatagaaaggtagnttgagagacatgttagctgagggag

SEQ ID NO: 43912 - DNA, 467 bp, Homo sapiens
  misc_feature 34: n = A,T,C or G
actatccggaaaatctaagaatatcctctttgtnatcacaaaaccagatgtctacaagagccctgcttcagatacttacatagtttttgaggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgtt

SEQ ID NO: 43913 - DNA, 298 bp, Homo sapiens
acgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacaccactggcctataataaatgggttaatttatgtaac

SEQ ID NO: 43914 - DNA, 363 bp, Homo sapiens
atccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgattt

SEQ ID NO: 43915 - DNA, 473 bp, Homo sapiens
atttttcagaaacttaagaaatcatttacaatctactgatcataatgggttttatttttagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctt

SEQ ID NO: 43916 - DNA, 346 bp, Homo sapiens
attgcaacactgtttacaatagccaagatttggaagcaatccaagtgtctgtccaacagatgaatggataaataaaatatggtacatatacacaatggagtactattcagccataaaaaagcatgagatcccatcatttacaacaacatggatggaactggaggtcattatgttaagtgaaataatccgggaacagaaagacaaacattgcatgttctcacttttttgtgggatctaaaaatcaaaacagttgaactagtggacatggagaacagatggttgatgaccagaggctggaaatggtagtggagggttgtgtgggaaggtggggatggtaaataggtac

SEQ ID NO: 43917 - DNA, 475 bp, Homo sapiens
gctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctg

SEQ ID NO: 43918 - DNA, 474 bp, Homo sapiens
attccactgagccccctacagccgaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtttggtggtcacctttgctccagtcaacgttacaacggaagtaaaatctgtcgaaatgcaccatgaagctttgagtgaagctcttcctggggacaatgtgggcttcaatgtcaagaat

SEQ ID NO: 43919 - DNA, 368 bp, Homo sapiens
taagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttcc

SEQ ID NO: 43920 - DNA, 468 bp, Homo sapiens
gtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctta

SEQ ID NO: 43921 - DNA, 169 bp, Homo sapiens
  misc_feature 4, 16, 24: n = A,T,C or G
cccngggaattcggcnttatggcnaggaagaattaactccttcatatttctagtagcacaactgataatattgatattttctacaaatgttacttctaaaattacagacaaaattacttacacaattcagttaagatgctttgacactgaataaaatattgatttcatg

SEQ ID NO: 43922 - DNA, 110 bp, Homo sapiens
atgggaaaagtggtgaatcccacccaaaaataactgcctctcgctcctcaacccctcccctccatccctggccccctccctggatgacattaaagaagggttgagctggt

SEQ ID NO: 43923 - DNA, 112 bp, Homo sapiens
  misc_feature 112: n = A,T,C or G
ctttctgagatctgcttttagtgaagtggatcaatgatgaaactagccaaatctgagcatcagaagtctttccagtctacctgatgcatgatctctacagttctgagaagcn

SEQ ID NO: 43924 - DNA, 415 bp, Homo sapiens
ataactactctgtaaagtaagtactatgctcattttatggatgagaacgcagtctcacaaaacatgagtagtgtgccctaagtcatatggaattaggttgaaacgtagatctctgtcacttccaatatgttaattgttaatcaccccatgggacattgtcttgtcagattttagttgtgagtgtgtttgtatgacataaagagtaaataaggtcgataaaataaatgcttataagcttagaattggtgactttctcctatgaaatattatcagatgcttctgaggttgaatggaaaagtttaactttgcacatgtcctaagaagatcaggtagaaaaagtgattctctggaggtaaggagaatgcctgctgtagatagaaaggtaaaagtccttttgaatcataaagagtaacac

SEQ ID NO: 43925 - DNA, 311 bp, Homo sapiens
  misc_feature 114: n = A,T,C or G
gtattaacaacttaaattagatttttctaactgatagttttcactcatttataatcagtaggagagactgtctagatgttggggcagctctatgatttaagtctgtaacatgtnctaactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaaagttgtcctt

SEQ ID NO: 43926 - DNA, 360 bp, Homo sapiens
agatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggctaacatggtgaaaccccgtctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctc

SEQ ID NO: 43927 - DNA, 467 bp, Homo sapiens
  misc_feature 444: n = A,T,C or G
caagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggggtgncctagaagtttaagcccagagtc

SEQ ID NO: 43928 - DNA, 218 bp, Homo sapiens
gcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttg

SEQ ID NO: 43929 - DNA, 471 bp, Homo sapiens
  misc_feature 442: n = A,T,C or G
aaaaagctttgactagtctttttttaaagtatctgatttaagcacttttattttttaagccaattaattagagctcttttatgtatttttagtagtgaaacgttgtgtacacaacacataaatacatagatgtattaggcatgctgatagaagtacatgttatgatttttaaaacttcttttctttcttagacttctaaattcttaataacctgtttcaccatcctaggcaattgtcagctaaatagccctaaatttgtatttaaaggaaactacctcaggtgaaaatcaaatagcaaaatttatatcatatggtatggagagaaaaagtctggcgtgccaaagggaaattaaaaccaatttaactgccaattaaacataaaattatagaatttataaaggtcttttaaatacacacacacacacacacacacacacactcnctcacacaaagattctgtagcatttactt

SEQ ID NO: 43930 - DNA, 219 bp, Homo sapiens
atgatagaaaagacacaagactaattcttatgtttttataaatgctgggattacaggcctgatccaccatgccggctataaattactttttatgattaaaaaagtcagtgactgggcatggtggctcatgcctgtaatcccagcactttgggaggctgagtcaggaggatcacttgagcccaggagttcaagagcagcctgggcaatgccatctctgtt

SEQ ID NO: 43931 - DNA, 467 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctta

SEQ ID NO: 43932 - DNA, 166 bp, Homo sapiens
  misc_feature 9: n = A,T,C or G
aggcacagnaaagaaaatactccatgtactgtacttatgtggaaggtaaaaaagatctcatagaagtagagagtggctcatgcctctaatctcggtgctttaggagtctgaggtgggaggatcacttgaggcctggagtttgaggccagcctgagcaacatctctc

SEQ ID NO: 43933 - DNA, 167 bp, Homo sapiens
aggcacagcaaagataaatactccatgtactgtacttatgtggaaggtaaaaaagatctcatagaagtagagagtggctcatgcctctaatctcggtgctttaggagtctgaggtgggaggatcacttgaggcctggagtttgaggccagcctgagcaacatctctc

SEQ ID NO: 43934 - DNA, 142 bp, Homo sapiens
caatcacacataccctgtcctttcccttttctttgaagcactcatccaaatttaattatttgtgtgataatttatgggtagccagcctttctcacaaaactccaagcccacgtaggtgacacagctcctactagcacatagg

SEQ ID NO: 43935 - DNA, 471 bp, Homo sapiens
  misc_feature 466: n = A,T,C or G
gaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgngtgtc

SEQ ID NO: 43936 - DNA, 143 bp, Homo sapiens
  misc_feature 65, 143: n = A,T,C or G
caatcacacataccctgtcctttcccttttctttgaagcactcatccaaatttaattatttgtgngataatttatgggtagccagcctttctcacaaaactccaagcccacgtaggtgacacagctcctactagcacataggn

SEQ ID NO: 43937 - DNA, 161 bp, Homo sapiens; identical to SEQ ID NO: 33554

SEQ ID NO: 43938 - DNA, 454 bp, Homo sapiens
  misc_feature 235, 238, 316, 448: n = A,T,C or G
atctgaaaacatggcagtcaccttaaaaaattaaattaactgttaaattaaaatccatttgtctggtagtgtaggatagagtccagaaatagatccacacatacatggacagttgatttttggacagaagtgcaaaagcaattgcataaaatataaaggatatcgtttttcaacaaatggcactggaatagttgaatagctgtaggaaaaaaaaaagaactttgagctatagctngtnccatataccaaaattaactcaaagggctgttagacctcaatgaaaaacctaaaactatgaaacttctaggggaaaatntaggagaaattcttcggaatcttgggttagaccaagatctcttaggtatgactccaaaagcatgatccataaaagaagtggataaatcagatgacatcaaaattcagaatttctttcaaaattagaaagacncttaac

SEQ ID NO: 43939 - DNA, 195 bp, Homo sapiens
  misc_feature 33: n = A,T,C or G
gaatcttagttcaactttaaatttgcccacagnaaccctctaaatccccttgtaaatttaactgttagtccaaagaggaacagctctttggacactaggaaaaaaccttgtagagagtgtaaaaaatttaacacccatagtaggcctaaaagcagccaccaattaagaaagcgttcaagctcaacacccactacc

SEQ ID NO: 43940 - DNA, 362 bp, Homo sapiens
cacaagtgaaggaattggctttagaaaggagcatggggaatctaatctcaatgtcagctggtatattagtctgttttcacactactataaagatcctacccaagactgggtaatttataaaggaaagaggtttaattgactcacagttccacatgactagggaggcctcaggaaacttataatcatggtggaagttcagttagaatggcgatcattaaaaagtcaagaaacaacaggtgctggagaggatgtggagagatacgaacacttttacactgttggtgggactgtaaactagttcaaccattgtggaagacagtctggcaaatcctcaaggatctagaactagaaataccatttga

SEQ ID NO: 43941 - DNA, 222 bp, Homo sapiens
gttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgattt

SEQ ID NO: 43942 - DNA, 179 bp, Homo sapiens
catagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtgtgaggtctttaaagttattgctttatttggttttttaatatat

SEQ ID NO: 43943 - DNA, 471 bp, Homo sapiens
  misc_feature 398: n = A,T,C or G
gataacccaccatggatacattttggtggcccactgggtactgtgaggactgctacattgatggatgttattggctaatccactgcatggtttgatggccaccatctcggttggccctttgggtgtgatggtgatagcatttcagtgacatcttctttggccccccccattaggtgctgtgcccacttcttttttggtgtacttggcacagtaggtgccaagttggccaccattctgtgtaacaccttttttggcccattgggtgctttgatggacatcatactgggtaggtgacaacgtcagtgggccaccatgtgccatgatggctgctgcagccccgtgttggccatgtcgtcaccattctctctggcatgggttgggtaggggatggaggtganaatactccttgggtttctctgaagcccaccctttcccccaactctggtccaggagaaaccagaaaaggctggt

SEQ ID NO: 43944 - DNA, 453 bp, Homo sapiens
accgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccac

SEQ ID NO: 43945 - DNA, 135 bp, Homo sapiens
ataaaaggattgaaataatacagagtgtgttctctgaccatagtacaatgaaatttaaaaatcagtagtagaaaaaaattggagaaactcacgaatatatagaaattaaatacacttctacataactgtcacacc

SEQ ID NO: 43946 - DNA, 372 bp, Homo sapiens
tgatgttggatttcagtaggttgcagctaatgttgaatatatttcagatgctgtaccctctctgtgaactatgaagacatgattagcagatacaattagctactttagcattaaaaaaaaatcaaaagatctagattttagttattgccctgttggttattactacattggcttctgcaatagtttatttctaaagcaggaagagagtggaaaatgggtagacctgagaatacagcatttcttttttcttctgaaggaaagaaacccagcactctttcaaaagctgtgaaagcattctcatgatctggtagatcccatctgtgcgtttttcagtgacatacttcaagtacacgagctgccgtcaaaggacca

SEQ ID NO: 43947 - DNA, 424 bp, Homo sapiens
gaaaaattataaccagctaatatagcaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 43948 - DNA, 325 bp, Homo sapiens
cacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctccgc

SEQ ID NO: 43949 - DNA, 325 bp, Homo sapiens
  misc_feature 195: n = A,T,C or G
gacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgcnaagtgtgcccagggctgcatctgcaaagggacgtcagacaagtgcagcttgctgtgcctgatgccaggacagctgtgcctctcagatgtaaatagagcaacctatataaacctggatttttttttttttt

SEQ ID NO: 43950 - DNA, 393 bp, Homo sapiens
gctttttttgtccgacatcttgacgaggctgcggtgtctgctgctattctccgagcttcgcaatgaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatca

SEQ ID NO: 43951 - DNA, 472 bp, Homo sapiens
aggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaaacaaactttctgcctccttggaaagctctacatctccttgtgattggagtggggggtttcaagattccagaaggagaaaaaaagcaagagc

SEQ ID NO: 43952 - DNA, 499 bp, Homo sapiens
  misc_feature 2, 274, 309, 311, 348, 360, 362, 401, 468, 488, 496: n = A,T,C or G
tnttggccggggagttgggacttaggtgagatggagggggcactgagcatgtcatatttcctataactcatggtagttcaatagttttctcaatagcatgttagaatagctagttttctttgttaggagaaaatgctgatgaaatcaacagtactgtaatttctttgttctatacacacagtttatgttgaactaccacaatggaatttttttttttaagcaggaagggcaggagagtggagacagaaataaaccttttaaatcttctttacgngaaccccacaaggacataagcatttagcagattananagcgtttggatttatagatactatcctctacagtagnggtcttcaatgngngatccagggaccccctgcggggccccaaggccctctcanaagctccaagagataaaaaccagttccataacaatactgaggcattgtttcccctttttactacggngaccatttgtattaaatggngcaaagcnttg

SEQ ID NO: 43953 - DNA, 410 bp, Homo sapiens
  misc_feature 102, 128, 145, 179, 212, 287, 299, 324, 329, 345, 362, 378,398, 404: n = A,T,C or G
gaggcattgaggcagccagcgcaggggcttctgctgagggggcaggcggagcttgaggaaaccgcagtataagtttttttctctttgaaagatagagattantacaactacttaaaaaatatagtcantaggttactaagatatngcttagcgttaagtttttaacgtaattttaatancttaagattttaagagaaaatatgaagacttanaagagtaccatgaggaaggaaaagataaaaggtttctaaaacatgacggaggttgagatgaagcttcttcatggngtaaaaaatgtntttaaaagaaaattgagagaaaggnctacngagccccgaattaatnccaatagaagggcaagngcttttagattaaaangaaggtgacttaaacagctnaaagtntagttt

SEQ ID NO: 43954 - DNA, 311 bp, Homo sapiens
aacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctacctttttttttgagtttattctgattgattttttttcttggtttctggataaaccaccctctggggacaggataataaaacatgtaatatttttac

SEQ ID NO: 43955 - DNA, 211 bp, Homo sapiens
aggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctta

SEQ ID NO: 43956 - DNA, 476 bp, Homo sapiens
atagaaggatgcaataaaatctttagtgaatggagaaagaaagatctgtatagacttcaataatatgaaatttttctaatcaccgaatttatatttttcaaaatcttgatacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattg

SEQ ID NO: 43957 - DNA, 110 bp, Homo sapiens
  misc_feature 13, 14: n = A,T,C or G
aattttttgaatnntttgaatttcctaagacaggtccttccttcattgtatgttttacttgggtaggtctgagcacatctcattacttattaaagcttatttgattgtac

SEQ ID NO: 43958 - DNA, 485 bp, Homo sapiens
  misc_feature 32, 58, 78, 454: n = A,T,C or G
aaaagttaaacaaagtctaaaaacaaagtctntgcaaaccacttaaaaataatttccntagtagtttttcaggtcacngtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatatttatcagtaactttatccccagtgtcagtatttataaaatggtttattaaggctagaaaaaatgaatacaatatcctgaaggngaaatatattctcttcaattagcataaatat

SEQ ID NO: 43959 - DNA, 497 bp, Homo sapiens
  misc_feature 7: n = A,T,C or G
aagaccntgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgctttgatgttacatgcaagactgttgccaatatgatcaaggggaaaactcctgaggagattcgcaagaccttcaatatcaaaaatgactttactgaagagggaggaagcccaggtacgcaaagagaaccagtggtgtgaagagaagtgaaatgttgtgcctgacactgtaacactgtaaggattgttccaaatactagttgcactgctctgtttataattgttaatattaaga

SEQ ID NO: 43960 - DNA, 341 bp, Homo sapiens
agcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtaccgcctgtaatcccagtgacttgggaggctgaggcaggagaattgcttgaacccgggaggcggagtttgcagtgagccaagatagtgccatcgcactccagcctggacaacagagcgagactccatct

SEQ ID NO: 43961 - DNA, 466 bp, Homo sapiens
caattctagaaatttatccaacaaaaataaaagcatatatttacacaaaaacctgtttgagaatgcacctaagtcctttatttgtaaaagctaattctgaaagcaatctgaatattcactaacagactaatgaataagcaaactctgacaaatacgtaggcaactcagaaacatgaggaaaaataaacaaatgatacacacaaatatttggctaaatctcaaatatgtatttatgctaaagaaaataaaccagatacacactcacacacacatcctgtaggaattctaattattggaatttgaagatgaacaaaattaatcaatcatgatagaaattataagggtttaatccgagttatttgggatgctgaagccggagaatcgcttgaacccgggaggcggaggttgcagtgacctcacattgtaccactgcactctagcctgggtaacagagtaagactacgtc

SEQ ID NO: 43962 - DNA, 474 bp, Homo sapiens
agaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatctcgatgtctttgttaagactgctgaagaattattttttttcttttataataagggaataaaccccacctttattccttcatttcatctaccattttctggttctt

SEQ ID NO: 43963 - DNA, 369 bp, Homo sapiens
  misc_feature 7, 8, 37, 51, 52, 58, 60: n = A,T,C or G
ctcggcnntctttggcccggggctttccggcggtgancgaccctacgccanncgagancntgccctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgggc

SEQ ID NO: 43964 - DNA, 482 bp, Homo sapiens
  misc_feature 429, 433: n = A,T,C or G
attggtaattttgtttacaaaatgggaatacaagcctataaaaatccaagtataggtgttctgagaaaaaattgtccaaagctcatttacacagcagggtgaatagaaaaagcttacctgagcttatatgctgaacttgaagttacatagttaacacatgtgaatacaatctccttgtaaaaagttaaaaaaaatcaggtagggccaaataagatccctcatgaggactatatgccccttatgaggactatacacccctgcttcagtttcctccctggtttgtttctaacttacaatggatacatgatccaaaataacatttctgagtattttatcaaccatcacacactgaaactataaatacatttttgttatgcaagctgaatactaaacaatgagacagaggatttttatttttttttggtttanggangggacaaacacaaagctcattttctatcaagttaaaataaattagacta

SEQ ID NO: 43965 - DNA, 475 bp, Homo sapiens
  misc_feature 428: n = A,T,C or G
agcctcccaagtagcttggactctaggtgcctgccaccatgccctggctaatcttttgcagcgatgggattttgccaagttgcccaggctgatcttgaactcctgggctcaagccatcctccctcctcagcctcccaaaattctggggttacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataaattnattctttctattactgaattaaaaaatcagaggtccctgttatattt

SEQ ID NO: 43966 - DNA, 430 bp, Homo sapiens
  misc_feature 17, 23, 53, 65, 77, 88, 94, 395, 422: n = A,T,C or G
cggccgggggtgttttnctgttnccttgttttcacttgatctgttttaagtantgagaggcttantagtgccctccnttgtaaatccntagtcntctttttaagcttattgtgtttaagaaagtagctatgtgttaaacagaggtgatggcagcccttccctagcacactggtggaagagaccccttaagaaccctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtctgnttattttttctttaaaaataaagggantttttgga

SEQ ID NO: 43967 - DNA, 488 bp, Homo sapiens
  misc_feature 11, 16, 28, 29, 50, 464, 484: n = A,T,C or G
accacgaaccntaaantaaagtgttctnntaaccctgatctctttgcccntttgctactgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattggagaagtgccctaattgaatgtgttttgaatgttatccttgcacaattctttaaattgaaagataaaaatgttttacctcactgttggacatacattccaagcttttcaactctaggagaaaaagaaaatcatgttttcctgtattgtaaaattttagnactatttcatatacatttgnattt

SEQ ID NO: 43968 - DNA, 499 bp, Homo sapiens
  misc_feature 10, 80, 329: n = A,T,C or G
tgtttggatntcaaaagcaaataaaaacccaattcagtctcttctaagcaaaattgctaaagagagatgaaccaccttantaaagtaatctttggctgtaaggcattttcactctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatttnttattttctgaatcgagatgtccatagtcaaatttgtaaatcttattcttttgaatatttatttataatttaattatgacagtgaacattctgattttacatgtaaaacaagaaaagttggaagaagatatgtgaagaaaaatgtatttttcctaaatagaaataaatga

SEQ ID NO: 43969 - DNA, 468 bp, Homo sapiens
atgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggattggtggtcaccttttgctccagtcaacgttacaacggaagtaaaatctgtcgaaatgcaccatgaagctttgagtgaagctcttcctggggacaatgtgggcttcaatgtcaagaatgtgtctgtaaaggatgttcgtcgt

SEQ ID NO: 43970 - DNA, 479 bp, Homo sapiens
  misc_feature 2: n = A,T,C or G
tntattggccgggggcgcaatagatattagtacccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttatagggtaggaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 43971 - DNA, 470 bp, Homo sapiens
aggcggcagagtgttgagatatgcagtatctccatgcagtagcccaagtgaaataaagtgaagctttatttcaaagaatgtggagtttttgttttttctctttccaatcagtctttagcacattccaacctcttgtactgactcacctttatgttaccttctgctgaacctgtggtaaaatattcctcatagggatccaaggccagagccttaatagctgagtcatgggcctggaacgtgtgaatgagctgcctttgcctgatgtcaaaaatgcagacgtgtcctttcctaccccccgagattaggagttgctgtttgggtgcatactgcagtaccgtggcaccatgatcgtggcacgtgaaacctgaagaagaaaaacatcagagaatttctcaaaacaatttcttgtcttggtaattatgatgtctacatccacatttaaatacagaccttactgatgcatttttcat

SEQ ID NO: 43972 - DNA, 202 bp, Homo sapiens
  misc_feature 10, 24: n = A,T,C or G
tctgaaggantttcaaagtccccntgtgttttgttgcatttaggattaacaatggacaacacaaagccccagtcttactactttactattgtaccagtattttggtgatagagagcaaaggaaaaacacatcagaacagttgccttaacactgaaaaacataccctgcattttgaaaatgtttatggatgtctcagcagttc

SEQ ID NO: 43973 - DNA, 471 bp, Homo sapiens
aaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaag

SEQ ID NO: 43974 - DNA, 480 bp, Homo sapiens
gaaaataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaaggcagaggcaggaaactaactggtgtgagtcaaatgccccctgagtgactgcccccagcccaggccagaagacctcccttcaggtgccg

SEQ ID NO: 43975 - DNA, 257 bp, Homo sapiens
  misc_feature 247: n = A,T,C or G
aactcgatcctgctggctgctgtctctattctctcggcctgtcagcaaagttattttgctttgcaagttggaaaggcaagattaaaatacaaagttacgcccccagcagtcactgggtcaccagagtttgagagagtattttcgggcacaacaaaactgtgtggagttttatcctatattcataattacatttgtggatggctgggtggtatttcaaccaagtttttgctacttgtctgggtctggngtacatatat

SEQ ID NO: 43976 - DNA, 357 bp, Homo sapiens
  misc_feature 5, 7, 53, 56, 75: n = A,T,C or G
gactncnttttgtagtgtacactagtagtcctcaagtcttttgacagaagtantantttttaaagaatttactantgtgatgaatccctaatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataaccttgttggct

SEQ ID NO: 43977 - DNA, 473 bp, Homo sapiens
atgtaaatcgtgccttagaaacacatctgttgtcttttctgtgtttggtcgatattaataatggcaaaattttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggccgaggtgcctttactacatgtgtgatctgaaaaccctgcttggttctgagctgcgtctattgaattggtaaagtaataccaatggctttttatcatttccttcttccctttaagtttcacttgaaattttaaaaatcatggtt

SEQ ID NO: 43978 - DNA, 279 bp, Homo sapiens
atagcagaattaaatttgaaattcacaatagaaaaaaatctagaaaaaccccatttagttggaaattaaatatacttctaaatagtttgtaggtcaaggaagaaattacaatggatattaaaatttttcaatcaaatgaaaacagaaatacaacatatcaaaatttatagatgcagctaaagtagtgcttgaagggaaatttatatctgtaaacacccatatcagaaatgaatgaaggtctcaaatcaataacttatgcttccatcttaagaaactaga

SEQ ID NO: 43979 - DNA, 473 bp, Homo sapiens
  misc_feature 57, 444: n = A,T,C or G
gagtaatagatttttgggttttagggtatatgtaagcaaccatctacttcaattgcntttactgtgattaaagtagttggttatttatagatttgcgtttctgagattcagaattatctgtgacactttgtagttgtgacaagaagcagagaaactctgtaaatgatttatttgtcaaagcatcaaaactaaaatgaatatgaggtgcttgtgcccatcacttttacttaaatattgttggatgtgagaggtatacaatacactttcccactgtattttgaaaatcacagttagattttgattttgtcatacattttcacagattgcatcatcagagaaaatacacccagtcattttgcggtgaaaacatgtaagcacctcattcataatgtaattcaggaggtataatcatactgtcatttttttatgtgtgtgtttaatggnatctattcagttgacttcagaaattttct

SEQ ID NO: 43980 - DNA, 160 bp, Homo sapiens
  misc_feature 2: n = A,T,C or G
cnactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 43981 - DNA, 471 bp, Homo sapiens
  misc_feature 57, 424, 449: n = A,T,C or G
gagtctctttggaaacttctgcaggggaaaagagctaggaaagagctgcaaagcagngtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgatttttagattttaagcaaaaattttaaagataaatccatttttctctcccacccccaacgccatctccactgcatccgatctcattatttcgggggntgcttggggggtgaacaatttttgnggcttttttttcccctataatt

SEQ ID NO: 43982 - DNA, 500 bp, Homo sapiens
  misc_feature 13, 21, 46, 283, 309, 441: n = A,T,C or G
tatggcccgggangagaatcnacagtttgtccctctccttttatcnaagcaggaagattctatatcctgatggtagagacagactccaggcagccctggacttgctagcccaaagaaggaggatgtggttaatctgtttcacctggtttgtcctaaggccatagttaaaaagtaccagctctggctggggtcccgtgaagcccaggccaggcagccaaatcttgcctgtgctgggcatacaaccctctgctttcacatctctgagctatatcctcattagtgnaaggtggcttttgctttataagtttnggctgggggagcactttaattcttcccatttcaaaaggtaatgttgcctggggcttaacccacctgccctttgggcaaaggttgggacaaagccatctgggcagtcaggggcaaggactgttggaggaaaanttagcccaagtataggctctgcccagatgccatcacatccctgatactgtgtatgcttt

SEQ ID NO: 43983 - DNA, 469 bp, Homo sapiens
  misc_feature 424: n = A,T,C or G
cagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtgggggatgtatttatgtaagaagggggggaaanaaggctgctatgactctttggatgggagtctggcaagaggaaatt

SEQ ID NO: 43984 - DNA, 471 bp, Homo sapiens
attgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaaga

SEQ ID NO: 43985 - DNA, 295 bp, Homo sapiens
  misc_feature 14: n = A,T,C or G
attggaactttgtnaaactttgtttatattttagtgaaaggagaggaaaatgttcgatcagaaaaaaatatatttctaatatattgaatattatcctatcattgccacatattgtgcactatcagaattacatatcatctttgtcttttcctactgtgggagttcgatcaatttgtaaaacaacataaatttttttctatgggccaaacagtgattagaatggctgaaacataatactgctctgaggtagctgaagctaatggtattaaacacaaagccatatggtaagatctgc

SEQ ID NO: 43986 - DNA, 473 bp, Homo sapiens
tggccaactatgcctctcagaacatcacctaccactgcagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattccttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggat

SEQ ID NO: 43987 - DNA, 128 bp, Homo sapiens
cacctgtaattccgctacttgggaggctgaggcacgagaatcgctttaacccaggaggcagaggtggcaatgagccgagatcacgccattgcactccagcctgggcaacaagagcaaaactctccctc

SEQ ID NO: 43988 - DNA, 469 bp, Homo sapiens
tgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaaccttcacagaagaacaatgatggaaaggttgcatctttttccagatgagtatattcccagaagatattctt

SEQ ID NO: 43989 - DNA, 307 bp, Homo sapiens
  misc_feature 2, 4, 54, 63, 67, 181: n = A,T,C or G
gntngaaaccctgcaattctaagaacatcactgatgaattacattttttttggngtgaaagtnaagnctaattgtttctggagaacattgtgtcccactgtttggttttggatttatcccttgcagactgagaggtttttgttttgtctgtttatcttcttaatgtagtgtttagaaattnaaatgggagccaatttagtttccatttactgaagtagattatcaaaggaaacaggaacactaaagactaggttagcatcccagagtattgcctcacatatgatgtgatttttcatgttttcctgac

SEQ ID NO: 43990 - DNA, 469 bp, Homo sapiens
  misc_feature 66: n = A,T,C or G
gtatcagtgtccaagaacaatctcattctctggccccagaagccagtgttcattactcgttatatnatttgtatgtgttttctaatacgaggaagtatgtatatgtgtgtatgcacatatatacatgtgtttacataatatataatttaaatgataaccaaaatcaagagaataaatcagtgcttaacaaacaatatgatcatcaagtacttagtatggaaagactattaaagaagaaaacaaaagattttagatttactctcagctgtgtgaccctaatcacttatctttactaagtcctcatctgtgataaataagcatcacctgggggcagatatgtggttaaaaacagaaattcctgcaccccaagttggaacccctaaatccatatttctaagggaagcccagtaacctttgtattttaacaattaaactgagggattcttatcaatattgcataggaattttt

SEQ ID NO: 43991 - DNA, 163 bp, Homo sapiens
attcctggtttaggtaagtccagaggtgagagctggtattaggaaaatgacatagtaaggcatttgttttcagtaatggcagcatccgtttgacctcctttcccatttggaagggctttctccatcctgaaagctcctgtagacttggtgctctttttttttt

SEQ ID NO: 43992 - DNA, 112 bp, Homo sapiens
  misc_feature 3, 17: n = A,T,C or G
aancatttaaatgattntaacatttgcctcacacttatacgaatgacacagggaaaagttgaacagaagaggtataattcttctatcctagaactacaaaatgtattgaaag

SEQ ID NO: 43993 - DNA, 309 bp, Homo sapiens
ctattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggg

SEQ ID NO: 43994 - DNA, 141 bp, Homo sapiens
tagtcgccgtgcctaccatggtgaccacgggtgacggggaatcagggttcgattccggagagggagcctgagaaacggctaccacatccaaggaaggcagcaggcgcgcaaattacccactcccgacccggggaggtagtg

SEQ ID NO: 43995 - DNA, 257 bp, Homo sapiens
gaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgattt

SEQ ID NO: 43996 - DNA, 338 bp, Homo sapiens
  misc_feature 2, 3, 74: n = A,T,C or G
cnnaacgtacccaagaaagtcgggatcgtcggtaaatacgggacccgctatggggcctccctccggaaaatggngaagaaaattgaaatcagccagcacgccaagtacacttgctctttctgtggcaaaaccaagatgaagggacgagctgtggggatctggcactgtggttcctgcatgaagacagtggcttggcggtgcttggacgtacaataccacttccgctgtcacggtaaagtccgccatcagaagactggaaggagtttgaaagaccagtagacgctcctctacttctttgagacatcactggcctataataaatgggttaatttatgggg

SEQ ID NO: 43997 - DNA, 492 bp, Homo sapiens
  misc_feature 12, 14, 20, 25, 29, 38, 58, 343, 379: n = A,T,C or G
acctgaagtcantntgttcntaccntttnacaactttntttgagattgagttaaatcntagcaatcaaatgacttttgaaacgcattcatcacaagagacagcttagaagaatgttctcttggggcttaaagatgcaatatcgacttttatttggtttctcaaattcaatgtgatacaaatatttactggtgaaaggtaccacaaaagtgctttatgcttcctatggggaagggactctgtaacataaacttgagttttgtaatttatacaaggacttaaatatataaacaataattttcttcatctttagaatttttaaagtaaatgaatacctatgattgnatggtttatttttttaaaaaaggtttaaaaattganggggtttggtccacaagcaaccgggactggctaccctggtcttatgacaattatgagctcctcacaactgtctgctataaatgcgaatgaactttattttctcaaggaaatat

SEQ ID NO: 43998 - DNA, 472 bp, Homo sapiens
tgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaaggattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcaatttttttttctctctcttggcattcttttttctcatactcttc

SEQ ID NO: 43999 - DNA, 471 bp, Homo sapiens
atcccatgcaacaacaagggagctcactcagtgggtttaatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatgggttgatggaaaaataaacatcag

SEQ ID NO: 44000 - DNA, 414 bp, Homo sapiens
  misc_feature 70, 87, 133, 171, 184, 257, 275, 281, 390, 413: n = A,T,C or G
actgataataagctttgaatggtgctaataagagtaggaattctctctattaaaaagaaaaaaaaaagtngcccttcctccacaggngatttagtaaatttagacagtagttaaactcttgttagtagacagnggggtcctcaaaattttactttgtaattcttcagaatngattatttttatngggtcaatacagagaaagcctttcagatctttgatatatcttagtcattaaaagaccttttcctatttgtatngataatgtattaaaagtngtttgngcttaataaaagacttctttaaacatcttatttaatttagtaggttacatcctatttccaaacatgagtgccttatttaaaagggcattcttaggactgtgaggatggnttaatattttgttttttcatggng

SEQ ID NO: 44001 - DNA, 469 bp, Homo sapiens
gatctgcaaactggattttggggaacaggtggagaggtatgaagaacgaggaacactgcccggggagtttcttcctctgcaaaataagggagtgtgtactgaattaccgtttccagctccaacatccaggatttcagcactacctgcagagtagtgggaggagagatagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttcttggtgttactcagcaacgcttttgttagcgcctttaccagcaagtacttgttaaacacttagatcttacaagtggaaagaaaattccgtggtaaattttaagtacc

SEQ ID NO: 44002 - DNA, 472 bp, Homo sapiens
gctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgttagaagattcaagggccagatcttgatgcccaacattggttatggaagcaacaaaaaaacaaagcacatgctgcccagtggcttccggaagttcctggtccacaacgtcaaggacctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgaagtaggcagctcatg

SEQ ID NO: 44003 - DNA, 225 bp, Homo sapiens
  misc_feature 19: n = A,T,C or G
gcatgtaatttgatttttnagctataaaatggagacaatacatttacctcaaaggatagttgtgaggagataaaatgtggcatataagagattagcacattgtccgatacttagtaaatgctcaaatgttagtcatttattacataaaagctcaaaacatctggatttttagtgtttcccttttgtactgtctgtcttatttatttacttatacctgccttgttc

SEQ ID NO: 44004 - DNA, 310 bp, Homo sapiens
  misc_feature 286: n = A,T,C or G
gaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaangagtcgaccctgcacctggtcctg

SEQ ID NO: 44005 - DNA, 218 bp, Homo sapiens
tggccaagcagaccaagaagatgctggacatgaaggtgaaccccatccagggcttagcctccaagtgggactacgaaaagaacgagtggaagaagtgagagatgctggcctgcgcctgacctgcgcctggctctgtcaccgccatgcaactccatgcctatttactggaaacctgttatgccaaacagttgtaccactgctaataaatgaccagttta

SEQ ID NO: 44006 - DNA, 366 bp, Homo sapiens
  misc_feature 366: n = A,T,C or G
gaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtagggatgan

SEQ ID NO: 44007 - DNA, 470 bp, Homo sapiens
  misc_feature 361, 407: n = A,T,C or G
aaacaatccaagtgttcatcaacagatggataaagaaaatgtggtatataaatacaatggagtatcatttatctatgaaaaggaatgaagtcatgatacatgctacaacatggctgaatctcgaaaacgtactaagtaaaagaagccagacacaacaggacaaatactatatgattccacttatatgaaataatttagaataggcaaattcaggcccgatgcagtggctcatgactgtaatcccagcactttgggaggccgaagcaggaggattacttgagcccaggagttcaaaaccagcctgggcaacagagtgagaccccatctctacagaaaattaagaaattagctgggcattggngggtagatgccttgtagtcccagctactcaggaggctgaggtgggnaagattgctttgaggtcgaggctgcagtgagtcatgattgtgccagtgtactccagcctggac

SEQ ID NO: 44008 - DNA, 473 bp, Homo sapiens
gaacttcaacattatactacaataaatgtcttctcatttgctgtacagacagccagaaagtataagtaattagaatttgttctgcactctacttttatcgtgaaaaagtaattgaaagtaaataagatatttattcagaaaagccactacctgaatgtgagcatatctgaactaataaaaatagtatagttaatacagatatatagcaagatgtcctcaccatctacatctgtaataatatatagtggtaattgactcccataatggttataccaaagccctgaagggttcttaacttttactttcatttttaatgcaaaaccaggttttcatatattttgcttgcttaaagcaagatatactagctcttatttttcttactaaattacatgcatacatatatttcaaattttattttagaattattttggggctcaaccccatacgttgtcatagaagtagtgcttttcaac

SEQ ID NO: 44009 - DNA, 421 bp, Homo sapiens
  misc_feature 42: n = A,T,C or G
aagatgaggtctgtgtatgctcacttccccatcaacgttgtnatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatattttaaatgatgcaattaaaagacctattggatttggaccttcttctt

SEQ ID NO: 44010 - DNA, 159 bp, Homo sapiens
aacatactattctttaaatcttactgtgtgaaatactggcattagttaatgtttactactaaatttaagactgtaggagctaggctgtgcattttgtttatgtatttaaattttgtttctaaaatgtatagatacaagtttcttccactgggatgagct

SEQ ID NO: 44011 - DNA, 400 bp, Homo sapiens
  misc_feature 8, 35, 43: n = A,T,C or G
aagtaaangcaggataataaagctcatataaatanctaacagnaacctgggttcctggtcactcttataagtagatttcctgtttttaacactttaataccagtgaagctggccgggtgtgatggctcatgcatgtagtccagtgctttgagaagcctaggcaggagactcacttgaggccaggagtttgaaactagcctgggcaacatgagacccacccccaccaccaccacccgtctctacaaaaataaaaagattagccgggtgttgtggcatgcacctgtaatcctagctactcagaggctgaggcgggaggattgcttgagcccaggaggtcaaggctgcagtgagctatgatcacgacattgctttacagcctgggtgacagggtgagatcctg

SEQ ID NO: 44012 - DNA, 185 bp, Homo sapiens
  misc_feature 21: n = A,T,C or G
gaaacccacgagtaacaaagnacacaacatacctgtaatctctgggacgcattcaaagcagtgtgtagagggaaatttatagcactaaatgcccacaagagaaagcaggaaagatccaaaattgacaccctaacatcacaatgaaaagaactagaaaagcaagagcaaacacattcaaaagctag

SEQ ID NO: 44013 - DNA, 443 bp, Homo sapiens
  misc_feature 8, 33: n = A,T,C or G
tgtcctcnttttcctttgcctaattgaagaaanattgcttgttttctagcctggcaagcatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttac

SEQ ID NO: 44014 - DNA, 181 bp, Homo sapiens
  misc_feature 165: n = A,T,C or G
tgtaacctggggataaggatcatggatatcccatggggttcttgggaggaccaaagaggttaattttagaatggcttggcacagagtaaacattatgtcagcttttactactcatggttgttatatgaacttttgaaagctctttttttttcggtcaggcatggnggcttatgcctgtaat

SEQ ID NO: 44015 - DNA, 203 bp, Homo sapiens
caagaacatggagtctcgctttgttgcccaggctggtctcaaactcctggcctcaagtgatccttctgcttggattaaattctaaaataagttatttggtgaaatttcctagttttggaaaactgtatatttttggttctttttgtttttgtttgagagggagttttgcactccagcctgggcgacagagtgagactggatct

SEQ ID NO: 44016 - DNA, 338 bp, Homo sapiens
  misc_feature 7, 9, 27, 32, 33, 34: n = A,T,C or G
agaagtncngaagtggaaaactggagnacggnnntccgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatagcact

SEQ ID NO: 44017 - DNA, 266 bp, Homo sapiens
  misc_feature 7: n = A,T,C or G
caaattnatcctgaagccttctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaacg

SEQ ID NO: 44018 - DNA, 383 bp, Homo sapiens
  misc_feature 6: n = A,T,C or G
gctctnccggggacgttgtctgcaggcacttattaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagct

SEQ ID NO: 44019 - DNA, 219 bp, Homo sapiens
  misc_feature 32: n = A,T,C or G
ataaggcctttagcatgttcctccttttcttnccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttag

SEQ ID NO: 44020 - DNA, 234 bp, Homo sapiens
  misc_feature 4, 29, 60, 231, 233, 234: n = A,T,C or G
cagncgcttgacgccttagataacagccntcctattgaagtgagccatactttctaaccnttagcctatgactgctctcatttacaatgaaatacgtaatttgttacatagatactttggactttgaaaagaagagaaaatagcatgggtgattttactggttcatatttctagtcttgaaaagctaataagtctaagttctaattaaacatttcttttaaaggtaggcantnn

SEQ ID NO: 44021 - DNA, 384 bp, Homo sapiens
  misc_feature 3, 4, 29, 30: n = A,T,C or G
gtnnaccaccaaggggttgttgaaaactnnttgtattaaatgtcttttgataagccttctgctcacatttttgtgaatgtctgaagtatatagtttgtgtatattgacagagctcttttataactaaagcaaatttaatttttttgtactaggaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattat

SEQ ID NO: 44022 - DNA, 432 bp, Homo sapiens
  misc_feature 7, 32, 33: n = A,T,C or G
gaaggcnatcttttaaaaagagattaaaccgnnggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggtaggatgaaacaatttggagaagatagaagtttgaagtggaaaactggaagacagaagtac

SEQ ID NO: 44023 - DNA, 482 bp, Homo sapiens
  misc_feature 17: n = A,T,C or G
ggtgcccccatattgtnagattatgatgaaataattatattattccctttgtttgatctgagaatgtaaaaagcaatactggtaaattacacactgctggacattgcttagatttactcttcaatgaattttgtgtccgtacgttcatgagatgagaaaaatagataggcaaaagtacctgttagtctgattgcagatctacccgtaatgcacaaatggtgatagtgtactttcttcttccaaaggtgggttaatggagtcatgatttaaaataagagtttaacagtagcgtgtataaatttgatatttatacatcataaatgatgtataaatcatttatgggagagtgatatttgattcagggatgttgacatgatacctttgggaaattctcatagtaaaatagagttagactgtcaacagggaaaattctaagtaatttgtgaagaaactagtagtagtagtctaaagtgaggcaccag

SEQ ID NO: 44024 - DNA, 496 bp, Homo sapiens
  misc_feature 1, 11, 63: n = A,T,C or G
ntttcccaggnaacccggtttttatggccggctccattgttgtccttgttgagagaggaaacntctccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagt

SEQ ID NO: 44025 - DNA, 481 bp, Homo sapiens
  misc_feature 8, 9, 36: n = A,T,C or G
atttttcnntaatgccgtattttattccaagagtangaactttattacagcttgttctctaaactgcctcatcattttagtggttcttggggacaatttttgtattcaacttaacagtttttttgagacaaggtctagctctgtcacccgggctggagtgcggtggtgcaagttttggctcactgcaatctccagctcccaggctcaagcaatcctcctgagttagctgggactacaggtgtgtgccaccacacctggctaatcttgtgtattttttctagagatggggttttgccatgttgcccagggtggcctcgaactcctgagctcaagcagtccgcttgccttggcctcccaaagtgttgggattataggcatgagccaccatgcctggccttcagctttattttatgaaggtacttaacatgtgacgttgttttcataaatctcataaattctctgatgaaaataggaccgtcat

SEQ ID NO: 44026 - DNA, 195 bp, Homo sapiens
  misc_feature 33, 34: n = A,T,C or G
agatatgccaactatgatttatccatacaatgnnttattatttagccatgaaaaaggaatgagatactgacacatgccacaacatgaatgaactttgaaaatattatgctaagtgaaagaagccgtaccaaaggccacatgttgtattgattccatttatatgagatgttcaggaataggcaaatctatacagac

SEQ ID NO: 44027 - DNA, 415 bp, Homo sapiens
  misc_feature 34: n = A,T,C or G
atgaaaaccgaattcaaaatggatcgtagacttncttgtaaaatgtgaagctattaaaacttttagaagaaaacaagagaaaatcttcaccaccaaaaacataatctagaagataatatatataagttgaactttaaaatttgctctgcaaaaagtgctgttagagaattaagaaaaaactacagcctgagaaaaaatatttgcaaaccgtctatccaacataggactcatatctagagaatataaacaactcttaaagcttagcagctaaaaaacagtttaattagaaaatggcggcctggcatggtggctcacacctgtaatcccatcacttcgggaggctaaggtggatgaaccacttgaggccaggggttcaagaccagcctacccaacatggtgaaaccctatctctact

SEQ ID NO: 44028 - DNA, 488 bp, Homo sapiens
  misc_feature 30, 474, 481: n = A,T,C or G
atggaacggtagtactacattttatttatnttgcatcgattggtggacatttggatcgtttctacttcttgactactatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcatttttaattgggntatttgncttttta

SEQ ID NO: 44029 - DNA, 483 bp, Homo sapiens
  misc_feature 34: n = A,T,C or G
atagacattctcacataagcccagttcatcaccnttttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactct

SEQ ID NO: 44030 - DNA, 338 bp, Homo sapiens
  misc_feature 34, 35: n = A,T,C or G
gaaggtgactccggcggaagaaggacaaggcagnntgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctgtgac

SEQ ID NO: 44031 - DNA, 483 bp, Homo sapiens
  misc_feature 35: n = A,T,C or G
gaggcacgctctaatttgcttctgagatggcttangactaggggaacactatttatggaggcttgaaccccttcattatgacctggtgctgttcggatttctctttgtgtgtgcatccctggaggtatatagttaccttttccttgactaagagctttcagaacatggagaggccatgcacaagaagacctcctacaaccagcggtgacctctttgatttcttggagggtttgtgtggtgattttagccagtcctccaggacttgacctgggcagcaatgaagggcccaaggtgtgctgagtgtgctgcagaggagagtcagaagccagagaggggctgttgtgccctctgcttgttacatcacttgaatgaacacccttctcatggtgatgataatatccaatcaaaacattgcctagtaaatgaaagaactcccagggaacaaagcaggaccaatttaagcaacaaaataaagtagtattg

SEQ ID NO: 44032 - DNA, 485 bp, Homo sapiens
  misc_feature 4, 18, 32: n = A,T,C or G
gaanaccctactcctganctttcactctgttnttttctcccaggcctcttctactatgccaggagatgtggcgtgctgttgcaaagttttcacgtcattgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactg

SEQ ID NO: 44033 - DNA, 335 bp, Homo sapiens
  misc_feature 32, 33: n = A,T,C or G
aaagtcccagcggctgaaggagtaccgctctnntctcatcctcttccccaggaagccctcggcccccaagaagggagacagttctgctgaagaactgaaactggccacccagctgaccggaccggtcatgcccgtccggaacgtctataagaaggagaaagctcgagtcatcgctgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtt

SEQ ID NO: 44034 - DNA, 471 bp, Homo sapiens
  misc_feature 5, 33: n = A,T,C or G
acggnccaatgactttgacgagttgagagattntggcttcagaagatcaaactactccgagctaaaggaggaagttcgaaccaatggcaaagaagttagaaactttgaaaaaaaattagatgaatggataactagaataaccaatgcagagaagtccttaaaggacctgatggagctgaaaaccacggcacgagaactatgtgacaaatgcacaaacctcagtaaccgatgcgatcaactggaagaaagggtatcagcgatggaagatgaaatgaatgaaatgaagcatgaagataagtttagagaaaaagaataaaaagaaacaaacaaagcctccaagaaatatgggactgtgtggaaagaccaaatctacgtctaattggtgtacctgaaagtgacggggagaatggaaccaagttggaaatatctgtaggatattatccaggagaacttccccaatctagcaaggca

SEQ ID NO: 44035 - DNA, 378 bp, Homo sapiens
  misc_feature 6, 14, 40, 41, 55, 164, 297, 309, 339, 345, 370, 374: n = A,T,C or G
acatcntagatggnctataagaataagggcatcaagagtnncccagctgattttnaattttagcattgtgattaacaccttctaaaattgccagaacttaataaataattgcttttcattattagtatgccatcaaatttagtagctgtttcaggctttaatgngtcaagcctaaaatccagattttggaggatcttctccctcttaaaagagtattcagttaactgccggggaaatacacatgtgtacaaggggcactggtatacattcagtctaaaaaataaaaatatgtatacngttctggggagnctagcacagcattgcccaataggaaatacnatgggngggcacaaaatggtggaccccatantagntaat

SEQ ID NO: 44036 - DNA, 482 bp, Homo sapiens
  misc_feature 473: n = A,T,C or G
gaggcaccgaggcagccagcgcaggggcttctttttgagggggcaggcggagcttgaggcaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaag

SEQ ID NO: 44037 - DNA, 500 bp, Homo sapiens
tcagcatggaaactttatgagatgcgttcccagctgtgtctgcaggccttggcacagggtctgacataatagaaccccagtaagcgttggttataggaggaacgctaggactggtgtcaaggccttgccccttgcttgggtgaggaggcccctgaatgtgttttctccccccttgaggctgcagatgactgtgccaaggctgtgatgagcaacttgagtgctcacggggtgaagctggtgctcccctccttactggctgccctggaggaggaatcgtggcggaccaaagctggtaagaccactcgctctgcctctcttcccagcttcctgttatgaaaaccagcctcagcaaggatcctgggtagccacagctcttgtcctgtgagctccccagaccagggataggggtaagactctgcctttttaaaaatttgagatggagtcttgctctatcacccaggctgggctttacctttggggctcaaaccattctcacagga

SEQ ID NO: 44038 - DNA, 483 bp, Homo sapiens
  misc_feature 6, 468, 471: n = A,T,C or G
aggaantcaatctttttctttgaaaagcatttgtagcaaaaaaaaagaaaatttcttacctgtcatctaaaattgacatggacatcttagtggactagaagttaagggcataaattctcccagtgatttttaattttagcattgtgattaacaccttctaaaattgccagaacttaataaataattgcttttcattattagtatgccatcaaatttagtagctgtttcaggctttaatgtgtcaagcctaaaatccagatttttgaggatcttctccctcttaaaagagtattcagttaactgccgtagaaatacacatgtatacaagggcactgtatacattcagtctaaaaaataaaaatatggtatacgttctgggggagtctagcacagcattgcccaatagaaatacaatgggaggtcacaaatgtgacccatatagttaattgggaaaattttctaaaaagnccncatttaaaaagg

SEQ ID NO: 44039 - DNA, 467 bp, Homo sapiens
  misc_feature 36, 58, 341, 342: n = A,T,C or G
gaagatccagcagcatgtattgagccttattttgcnccatgtactgttgtaagaactntacacatattagcttattaaagcacacgtcttcgtggggttagggttactgttgtcccatttctcaggtgacgatccagggcccaaggccacatagccgggtggtgggaccatgaggcaggcagacattagagattactctcttgacattggcctctactttcttaggacccttgccttacattgtacttggaatggcaaaacacttgtggtgtaatttgggagttcaatatggttagtttgggagagcagaagctctcttgagttaataatgtattgcagannaggcatggggacgtctaggaccttggctgttccctccccaaagctatagaacatcacagaaccagggaactgtggggctgggagagacctctgaggaagagctccttttttcaaccatccattca

SEQ ID NO: 44040 - DNA, 488 bp, Homo sapiens
  misc_feature 4, 34: n = A,T,C or G
attntaccaaagtttaatggactcacaattcctnttggctagggtgccctcacaatcatggcagatggcaaaagtcacgtcttacagggtggcagacaggagagaatgagaaccaagtaaaaggggtatccccttataaaaccatcaaatctcgtgagacttattaactaccatgggaacagtgtgggggaaactgcccccatgattcagttgtctcccattaggtccctcccacaacacataggaattatgggagctacaattcaagatgagatttgggtggggacacagccaaatcatgtcaacttggccatagtgactacaagaagcaggactgaacctgcatccggggcttgagtagattgtgcgcttgtttgtagcaccctgataagtacctggggacagagactggggaggattcttactatattttatcacattttctcagacaatgtaataggggatgctgcttgtcctcaacatctgct

SEQ ID NO: 44041 - DNA, 498 bp, Homo sapiens
  misc_feature 110: n = A,T,C or G
aaactaaccaacagtgagcatcttcaactaaaactacccctggatgtaataagtgtaagtattaaaattaaacattatatgtggtcatgaagagaaaattgtttcagggnctgtccaaactacacttcatagaaatttcataattatttttcattttagcatgtgaatgattgataaattggactaggtactgggttaaaaggacttttccaccatctaagagaaaggaagttcagagccttagcttcaacaccacaatttcttaactggaaaaggatcaatctaaaacggtggacttaaattttcaaactcatttttcttttaggccacagatctcaaaatcaaagaaagactgtttactataggacaaagtttcacactgatcactttcctgtagttagtcaataggcttaatatccttcctgcttggcattcgggctttcggcccagataatatgtttatgtttgtaaaagaccaaaatatactatctaccccca

SEQ ID NO: 44042 - DNA, 424 bp, Homo sapiens
tgtactttctcaccttaccgcctttcaccaacccactcaagttggactgctgtttttcaggtcactgataactttcatatttctgaatggttacacccacccctaactttttgcagtgcttaaggcaagagttcaaatggagagctataaaacatgttaccaagtgtttagaagttagaaatcaagcttttagactgtttaataaaatgtgtcaatttttttaccttaacaaacataactttatgttcactatatggtattgaaaaaaagctcgaagtgtttttcctacttttactcatgctccacttaacacaacacttctaacaccagatgtgtgtggggtctttccctgcagaccaactagttctccagtggacaccagctgggtgctctataattcaattcaattctgacattatttgtg

SEQ ID NO: 44043 - DNA, 260 bp, Homo sapiens
  misc_feature 8, 37, 139: n = A,T,C or G
gatcccanctgattttaatatctgatactttaatttnaatgagtaaggattcttcctaatttctatgatcagatacatgtatgtcatggataagaacccaactgttttttctctaagacaaaaatctaagatacttggncactaaaaatccaccagcattttatataattgttggtcactccctaatgccaagagtcagtgcaaaaaaagcatagaaaggtggcagaaaagaagaaaaaggcgagggcagccaattaaag

SEQ ID NO: 44044 - DNA, 484 bp, Homo sapiens
  misc_feature 5, 32, 57: n = A,T,C or G
gaagnccggcatctcaaatcggctgattcttnttctggaaactgccttcatcttganagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagcctggaagttaagttttcctggtttatgccatcggcaccgtactggatcctggccaccgactatgagaactatg

SEQ ID NO: 44045 - DNA, 207 bp, Homo sapiens
tagttcgagaccagcctgggcaatatagggagaccctctctctacaacaaattaaaaaatcagctgggcatggtggcatgtgcctgtagtcccagctactaaggaggttgagatgagaggatcccttcagccgggaaggtcaaggctacagtgagctgtaattgtaccactgccctccagcctgggtgacagagcaagaccctatcc

SEQ ID NO: 44046 - DNA, 482 bp, Homo sapiens
gaatcactcgttgtggttatgcgaaaaatgttgtgaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattattttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctaccgt

SEQ ID NO: 44047 - DNA, 475 bp, Homo sapiens
  misc_feature 12, 31: n = A,T,C or G
cctacccctganactttggaaaaggtggatngtagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagca

SEQ ID NO: 44048 - DNA, 105 bp, Homo sapiens
  misc_feature 6: n = A,T,C or G
tccggngggcagattagaacatgatgattggagatgcatgaaacgtgattaacgtctctgcgtaatcaggtcttgcaacaccctgattgctcctatctgattctc

SEQ ID NO: 44049 - DNA, 187 bp, Homo sapiens
  misc_feature 7, 34, 35, 178, 185: n = A,T,C or G
gacaaanccacaaattcaggagatataaaatctnnatcaattaattcttaataggctttatcgtttattgcttaatccctctctcccccttcttttttgtctcaagattatattataataatgttctctgggtaggtgttgaaaatgagcctgtaatccctcagctgacacataattngaatggngc

SEQ ID NO: 44050 - DNA, 461 bp, Homo sapiens
  misc_feature 2, 23, 36, 59: n = A,T,C or G
gntttcccttccggcgttcaagnatgtcgaattttngacgtggtgggtcctctggtgcnaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgtcattacaggaccagtagcaaaggagtgtgcagacttgtggccccggattgcatccaatgctggcagcattgcatgattctccagtatattt

SEQ ID NO: 44051 - DNA, 462 bp, Homo sapiens
  misc_feature 6, 32: n = A,T,C or G
attggnctaggagttaacacattcacatttantgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattac

SEQ ID NO: 44052 - DNA, 476 bp, Homo sapiens
  misc_feature 7, 32, 468: n = A,T,C or G
gattctncccctctctacaaccctctctcctnttcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtgggttggggggtctgccagcctggggccctccctgtcgccagtgggcacttttttttttccaccctggctccttcanacacgtgc

SEQ ID NO: 44053 - DNA, 232 bp, Homo sapiens
  misc_feature 7, 36, 60: n = A,T,C or G
aggaagnacttggaatcggccatgagtctggttttnacagctgtcgggtcagctggcggngctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagacga

SEQ ID NO: 44054 - DNA, 184 bp, Homo sapiens
  misc_feature 183, 184: n = A,T,C or G
gctaatttttgtattcttagtggggatggggtttcgccatattggccaggctcgtgtcaactcctgacctcgtgatctgcccaccgcggcctcccaaagtgctgggactataggtgtgagccgctgcacccggtccaagtaaaattattttaacaatatactatgaagagaaaaacactggcnn

SEQ ID NO: 44055 - DNA, 329 bp, Homo sapiens
  misc_feature 17, 20, 103, 175: n = A,T,C or G
gtcttgctgggaatganatnccgaaacaaatttgggaaataccattgttccttttttgtggagaaaggtaccctgtccaaaaagaaaaatgtcttgctttgcnagataaatgcaccgttttgcctaaaaaccagtgtaacattttattctaagtcagaagtaattactgagctgngggtttgtgttctgtatgtataatctcatttattgacagttctaacctagtaatgaaagtgcaacaggagaattataaccagaaacatctaactgttatattatacatacatgtactgtttaactgtaattgtgaaaatgcattttgaaagttg

SEQ ID NO: 44056 - DNA, 493 bp, Homo sapiens
  misc_feature 7, 8, 32, 33: n = A,T,C or G
acaatannggaataggaaaatttgatgctgtnnttttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctcccccgggtttgcaaatagaggctacccgggtgctgtattcagcaac

SEQ ID NO: 44057 - DNA, 144 bp, Homo sapiens
  misc_feature 32: n = A,T,C or G
cttccccaatcgggttctactttcttatttantgtaggaaagtctaagttactttaaaattttcaaattatttaaacctatttgtgttcctttaaatccgactgtacataatgtattaaatagttcactactggatttcattcc

SEQ ID NO: 44058 - DNA, 499 bp, Homo sapiens
  misc_feature 13, 442: n = A,T,C or G
gaaccctgcggtngtgacttcaatcacatcaatgtagaactcagccttcttggaaagaaaaaaaagaggctccgggttgacaaatggtggggtaacaggaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggnttctatgtctctgaaaaaggaactgttcagcaggctgatgaataagatctaaagagt

SEQ ID NO: 44059 - DNA, 169 bp, Homo sapiens
agtttctccagatgacttcaaaataagccttatttttgtaaatttatgttaaattttaggtgttaagttgtgaaatacctaatgatgtgggcctaaatttgcctcattcagactgagacagggctgttaaaattcatttctagctaataaactgtgctataacttcttt

SEQ ID NO: 44060 - DNA, 188 bp, Homo sapiens
gagggggcaggcggagcttgaggcaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 44061 - DNA, 361 bp, Homo sapiens
  misc_feature 4, 31, 33: n = A,T,C or G
gagncgagatctgtaattcatagtcacattnanggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgc

SEQ ID NO: 44062 - DNA, 262 bp, Homo sapiens
  misc_feature 7: n = A,T,C or G
gtgtacncgactgcacattggtttctgttctttggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagccttaatttttctgtattgcagtgtttataggcttcttgtgtgttaaacttgatttcataaattaaaaacaatggtcagagc

SEQ ID NO: 44063 - DNA, 365 bp, Homo sapiens
  misc_feature 7, 33: n = A,T,C or G
ggagagncctggctgctgtgtcccgcggcttgntctccgtagtggactccgcgggccttcggcaggaatctagaaaactgtatctgaagttgttcctacctgaagccgttgcattgagaggtgctaagtggatcctctggccagctgactgcacttcttttttgagaaaggaaggaatatatcctgactgattgtgggccacatccaatcagtggaaggtcttaagagcaaaaactgaggttcctcagagaagaaggaaatgttttaagacttcagcatcaattcctgcctgagtttctagcctgctggcctgctctacaaatttcaagcttgctagccctcacaatcacatgaataaattcctc

SEQ ID NO: 44064 - DNA, 455 bp, Homo sapiens
  misc_feature 6, 32: n = A,T,C or G
ctcacngcaacctctttctcccaggctcatgntattctcttgccttagcctcccaagtagctgggattacaggcatgtgccaaccacactaggctaatttctgtaattttagtagaaacggggtttcaccatgttgaccaggctggtcttgaactcctgacttcaagtgatccacccacctcagcctcccaaagtgctgggattacaggtgtgagccactgtgcccagaccatagaccacacttttaatagcatgatgtacagaatcagaagatatagcgaatcagtggaaattgaaattttctgaggctcttggtggcgtgtgcctgtaatcccagctactcaggaggctgaggcaggagaattgcttgaacccgggaggcggaggttgcagtgagcggagatcatgccactgtactccagtcctccagcctgggcaacagagcaagactccat

SEQ ID NO: 44065 - DNA, 496 bp, Homo sapiens
  misc_feature 15, 16, 40, 41, 42: n = A,T,C or G
tggccggctggattnngtagacctgatagatatctacagnnntttccactcaaaagcaacagaatatacattcttcttggcaccacatggcacttactctaaaactgatcacataattggaagtaaaaccctcctcagcaaattcaaaagaactgaaattataacagtctttcagaccacagcagaatcaaaatggaactcaaggattaagaagctcactcaaaacgacacaactacatggaaactgaacaacctcctcctgaatgactcctgggtaaacaataaaattaaggcacaaatcaagaacttatttgaaactaatgagaacaaagagacaatataccagaatctctgggatgcagctaaagcagcattaagaggaaaatttatagcactaaatgcccacttcaaaaagctaggaggatctccaattgacatcctaacatcacaactaaaagaactagagaaccaagagcaaacaaaccccaaagctagc

SEQ ID NO: 44066 - DNA, 101 bp, Homo sapiens
ctgaagcaggagaatggcttgaaagcggaaggcggaggttgcagtgagctgaaatcatgccactgcactccagcctgggcaacagagtgcgactccgtccc

SEQ ID NO: 44067 - DNA, 147 bp, Homo sapiens
tgtaaatgtgttggacaaatgtgaagatgcattgtggtttaaccatatgcccacatttagtctctttattcctagttggtgagaaacctgtatctttctatgctgcttttatatctgtatgtattaagtgatatttctctagtagtt

SEQ ID NO: 44068 - DNA, 119 bp, Homo sapiens
  misc_feature 2, 6: n = A,T,C or G
tntggnccatgaaaccattctttcctcctgggcctctgagcttgtgatgggaggggcttctttggaagtctctgagatgcctttgaggccttttccccattgtctttggatattagcac

SEQ ID NO: 44069 - DNA, 486 bp, Homo sapiens
  misc_feature 32, 458: n = A,T,C or G
gagaacacgcaggatatattagaatctgattntttctcaaggatatgaggtgcctgcagaactttatttacatgttaggaaattttaacatgagcttttcaagaaatggaattgaaaagtccagaggaagaggttgtggcagcacttgcctgaaggtatgagaccagattctaatctttatggttttccatgggaattggtgatatgtgcagctgttgttggattttttgctgttctctttttttttgtgggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggnagaaaatcaaatggtataattttaaaag

SEQ ID NO: 44070 - DNA, 483 bp, Homo sapiens
caaataattcacgacatctacaatatgccaggtactgggccagttctggatacagtggggagaaaggaaggcatggtcccttccacgacttccactttttgtttctttagtcaccctcgattaagggtgacctgtgttggtaacctgaatttcatctagaactgtggactgttctggctacaggttcaagtgctggggccggcagtggagagttccacgtgtacagacatctgcgccggagagaatatcagcgacaggactacatggatgccatggctgagaaggtcagtgagccagaaggctggctgagcccccatgtttgggcagtgtgcgtgtactttctttagaaaaaagcatttgaagaggctgggcgtggtggctcaggcctgtagtcccagcactttggaaggccgaggcaggggatcacctggggtcgggagtttgagaccagcctgaccaacatggagaaactctgtctctact

SEQ ID NO: 44071 - DNA, 362 bp, Homo sapiens
  misc_feature 7, 9, 35: n = A,T,C or G
atagaancntttttaccccaactactgaatccttntagtaccaaataatatatagtaaaactaagatttaaggttgtgtcaaaaaggtacagtgattcagccatttccatgtgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttc

SEQ ID NO: 44072 - DNA, 389 bp, Homo sapiens
  misc_feature 19, 22, 349: n = A,T,C or G
tggaagacttcattggatnganccagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgngttaaattaattttaataaattatataattatacatattg

SEQ ID NO: 44073 - DNA, 500 bp, Homo sapiens
  misc_feature 23: n = A,T,C or G
gagatggctagtgcttcatccanccaaagaggtcgaagtggttctggaaactttggtggtggtcgtggaggtggtttcggtgggaatgacaacttcggtcgtggaggaaacttcagtggtcgtggtgactttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacaagatttgtgaactcagccaagca

SEQ ID NO: 44074 - DNA, 180 bp, Homo sapiens
  misc_feature 24, 180: n = A,T,C or G
gaatgcggggtcgagagctgatgngcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagcggn

SEQ ID NO: 44075 - DNA, 357 bp, Homo sapiens
  misc_feature 4, 19, 179: n = A,T,C or G
acgngcagctcgccatctncaccccatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacntcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagact

SEQ ID NO: 44076 - DNA, 207 bp, Homo sapiens
  misc_feature 24, 27, 206: n = A,T,C or G
aaatgaattgtaaatgcaaggtgnttnttggagtgtgttattgttattttacttgatttatgagttatatgtgttggggtagtgaaaaggactcatttttgctatacctttttctttttcaaatggtctagaaaaatcgaggttggccaccatgaatttactcaaagcatagagttttatatgattaattcttcatataaattatnc

SEQ ID NO: 44077 - DNA, 411 bp, Homo sapiens
  misc_feature 382, 406: n = A,T,C or G
agtaggattattcagtagatatgcgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggggggtgtntctatttaaaaggttatcaattanaaatt

SEQ ID NO: 44078 - DNA, 404 bp, Homo sapiens
  misc_feature 24, 25: n = A,T,C or G
gattaggcgggtagcaatagaggnnatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaaga

SEQ ID NO: 44079 - DNA, 433 bp, Homo sapiens
  misc_feature 31, 33, 34: n = A,T,C or G
caaagcccaaagcttcaatattggatactgntnngtatacatgaaagaaaattcctttccgaagctattaaaccatttttttcctatgtgaaagttgaggacaatttatatagctcactttttgtcatgtaaaaaaggttactcaagttgtactacccacataactgaaaatattggccatttggccttatctgtgagatttgacactaagtttttgttagagattggaaattatactagtccttttaaggggtaaaaaattcaattcaatactgacaaacttttgcttgtagttttactgtacatttatttttaaagaaaaagaaaacaaaagccagacaaacccaagttgtccaggcaaataaactcaaatctttgtcacgtctgatattataatcttctatgtaagttttttaattaaaggtatttctat

SEQ ID NO: 44080 - DNA, 410 bp, Homo sapiens
  misc_feature 24: n = A,T,C or G
catcaaaacagtagtttaaagagncgaaaaactgaagttgatgttttcttaacaggaagcgtaatggttttccaaactaaattccaaccttgaaatagacttaaaaatgctttaaggtacagttggctgggtgcaagtggctcacgcctgtaatgccggcactttgagaggctgaggtgggagcatcacgtgaagccaggagttcaagaccagcctggccaacacagcaaaaccctgtccctagtaaaaataccaaaaaagttagccaggcatggtagccgcatgcctctaatctcagctactcgggaggctgaggcaccgagaatcatttgaacctgggaggcggaggttgtggtgagtgagactgtgctaccgtactccagcctggacgacaaagcaagactctatcg

SEQ ID NO: 44081 - DNA, 303 bp, Homo sapiens
  misc_feature 17, 19, 44, 46, 265, 276: n = A,T,C or G
atggcccggggaagggncngaaaatctggattctaccccaagtncnggggcacagatagaaagctgctgagagactacactctgaggtcagccttgaccctgaggctcatctggctctccctgttcctctacagccaggtaaaggttagaggcaagtctcggagatggaaacccaaggtcatgcagttgtgccaatgcccgttgttagacaacatgcttctattcctgacaaaccagtctcaagcagctctgactgatggggggnccggaattttncaaatggctctccaatgacttccaagt

SEQ ID NO: 44082 - DNA, 459 bp, Homo sapiens
  misc_feature 15: n = A,T,C or G
aactgtcccacatcnacaaaatgaagaacaaataccatatgatcatttcaatactaactgaaaaagtgtttgataaaattcagcatctctttgtgataacagctctcaacaaactgggtatagaaggaacatacctcaacataataaacaacaacaaacccacagctagtatcatactgaatgggggaaaaatgaaatactttcctttaaattctggaaacaagacaaggatgcccactttcaccactgttaatatagtactggaaatccttgccagagcaattagacaacagaaataaataaaaggcatccaaaagggaaaggaaggagtcaaactactcttgttagtagacaatataatcttatatttagaaaaaaactattagaattgataaattcagtgaagttgtaggatacaaaatcaacatacaatcagtcacatttctatatgctgacagc

SEQ ID NO: 44083 - DNA, 315 bp, Homo sapiens
  misc_feature 5: n = A,T,C or G
aggancatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttc

SEQ ID NO: 44084 - DNA, 461 bp, Homo sapiens
aagatatccattgcctaattggcagtcttctaggtggataagtagttctcaccaaaatattggaaaatgcctcactgaaaggtcttatacttttcctggttgctacaaattcacttggtagaactacgtttataataccaaaacaaactaccaaacattcttatatctttaagtagaagttttcaaaatgaggttttagagaaagattaacataaaagaagtaaacttggggtatgacttctataagggcttagatatttgctaaagttattaatacttgtggttaattcttccagagttcagagcatagaacagacatgccatttcaagaaggctgtagtcatgggataggttttgagaactgactgtgctaagctctcatttattttctgtgttttatactatcttgtcaactttgagctatccaagcattgattatcgattcagacttggagagttct

SEQ ID NO: 44085 - DNA, 435 bp, Homo sapiens
  misc_feature 7, 31: n = A,T,C or G
gaggacngatggctaacaggtgcagagtttntttttttctctctctatttttcctcatttggatgaagaaagaaaaattcagttagctaaggatttaagtcaactaaatttcaattaattgaaatgttaggaaaattaagtgttttttatttatagatgttatagtattactaatagatgaactttttaaaaaattagaattttcagcacaaccttagaataacttcttattctgtactaattttagatttttgaaacatgaatgttaaatataaagttaattgttttaaattgtttagttaatgaccaccaaaaacaatacctccttttctatttgaactgtcttaaaactcagagttaaatttaaaccttagctgggaaaaggtctatttcaggttcttctaatatctacctcaggtataaaatttcttttga

SEQ ID NO: 44086 - DNA, 423 bp, Homo sapiens
  misc_feature 20, 37, 63, 165, 248, 259, 298, 301, 336, 337, 363, 402, 415: n = A,T,C or G
aaggaaacccaaaaaaattntatactgaagttcattncaagaagaacggtgagtacagtgccntacaatatttagagagaaagaccacattgacataacttttatcgtaatttattgttataatcgttctattttattagttattgttaatctattgtgcctagnttataagttaaatgttataggcatgtatgtataggaaaaaacataatatatataggggtctgtactatctaaggctttaggcnttcactggggncttggaacatttcctctgtgaataaggggggactactgnatntttttgatgccctttttcccataaaggactggggnntctttcataaacatttacttaatgcncattggtgaccaagcaggctagaaatagtaagtagtctnctgtgggggaggnatacttgg

SEQ ID NO: 44087 - DNA, 194 bp, Homo sapiens
agtaaacgcactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtt

SEQ ID NO: 44088 - DNA, 497 bp, Homo sapiens
  misc_feature 2, 10: n = A,T,C or G
tncttcaagnctgagtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcagatgtttgagagctagatgaagattgggttcacctattgaaaatt

SEQ ID NO: 44089 - DNA, 372 bp, Homo sapiens
  misc_feature 29, 30: n = A,T,C or G
ctgcgagcgtaagtgcgggcagagcactnngccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggatggaatacagggggcacagttagatctgaattgttaagcagaggctgcttgatgc

SEQ ID NO: 44090 - DNA, 259 bp, Homo sapiens
  misc_feature 8, 34, 153: n = A,T,C or G
aacgagcnaggcgatccataaggagggctgtgtngagaagattgggggctggctgaggaaaaatgtgctggtggtagctgcagcagcccttggaattgcttttgtcgaggttttgggaattgtctttgcctgctgcctcgtgaagagtatcangaagtggctacgaggtgatgtaggggtctggtctcctcagcctcctcatctgggggagtggaatagtatcctccaggtttttcaattaaacggattattttttcac

SEQ ID NO: 44091 - DNA, 498 bp, Homo sapiens
  misc_feature 2, 11, 38, 39, 40, 452: n = A,T,C or G
cnggggggccncccactactgaaatagccgggagtacnnntcacacttttcttcaaataggcgatcttcttttactctcaatgatcttattgttccttgaacactgagtcacctcctgttcttttggaattgggtggggcatagttcttacacagatggtgaatatgttagtagttgtcttttgcatgggatcattttttccataaagcatgttttatttatggaggtttttccagagtctttcttcctgtcactaatttcttttcttcatttatttttcttaactgtttttaaagttctagaatgtttgttaaagcaaactatttatttttgtgaattttttcctggatcgcattttaagaaactagtccaatttatatgtaagcattaaaaatgagtcttgatgaatttatggacatttattaaggcatttgctatgttctaggtactgngttaggtgctagtgacacaaaatgtgtgtaagacaaggccttaaac

SEQ ID NO: 44092 - DNA, 222 bp, Homo sapiens
  misc_feature 143, 155, 184: n = A,T,C or G
atttttgcaggatgaatgcctgtatttggtctaggaacagtacattttagtctgatttagaattactggtagcttattttaaagcaggaaaagcagctgagctcaagtttgctgtctttagaatgggtttgtgaaaatatggnataaaaggggtnttcattttcctgtgcttacctattattgnataagagctattcatgccatttttttggggaaaccttt

SEQ ID NO: 44093 - DNA, 189 bp, Homo sapiens
gtatgtccttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttct

SEQ ID NO: 44094 - DNA, 298 bp, Homo sapiens
  misc_feature 13, 25, 26, 27, 28: n = A,T,C or G
ccatgtcaacagnattacctaccannnntattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaaagttttatttttctga

SEQ ID NO: 44095 - DNA, 436 bp, Homo sapiens
  misc_feature 6, 24, 49: n = A,T,C or G
cggtcntttggccggggggtcgcnagtcacgccactatcgaaaacgatnggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaagga

SEQ ID NO: 44096 - DNA, 239 bp, Homo sapiens
  misc_feature 2, 3, 32, 229: n = A,T,C or G
annaccctgaggtcgggagtttgagaccggtnttggccaacgtgatgaaaccccgtgtctactaggagtgcaaaaaattagttaggtgtggtggcgggctagtaattagctagtggtcccacctactcgggaggccggggcagggggatccgcttgggcctgggaggcggaggttgcaagtgggccgagatcgcgccactgcactccagcctgggcaacgagagcgaanctccgtctca

SEQ ID NO: 44097 - DNA, 485 bp, Homo sapiens
  misc_feature 33: n = A,T,C or G
cgcactcgatatagtaccgcaagggaaagatgnaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttatagggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccgattaagaaagcgttcaagctcaacacccactacctaaaaaatcccaaacatataactgaac

SEQ ID NO: 44098 - DNA, 289 bp, Homo sapiens
  misc_feature 1, 28, 29, 31: n = A,T,C or G
nggcccaagcgctgaaggaataccgcanntngcaccgggaggagtgagatgtggatgttgcttttgcacctacgggggcatctgagtccagctccccccaagatgagctgcagccccccagagagagctctgacgtcaccaagtaaccaggccccagcctccaggcccccaactccgcccagcctctccccgctctggatcctgcactctaacactcgactctgctgctcatgggaagaacagaattgctcctgatgcaactaattcaataaaactgtcttgtgagccg

SEQ ID NO: 44099 - DNA, 136 bp, Homo sapiens
  misc_feature 15, 16, 134: n = A,T,C or G
agcagggggggaaanncatttatagatcatttctaggcaaaattgtgaagctaatgaccaacctgtttctacctatatgcagactctttattttactagaaatgggaatcatggcctcttgaagagaaaaaagnca

SEQ ID NO: 44100 - DNA, 476 bp, Homo sapiens
  misc_feature 32: n = A,T,C or G
catataccggtgtgtacgtaggtgtatgtgtnttctctgcacgtatatctcttctgtcttgaagaccctgttaactttgtgaaataacttccacatttcaacacacttcacagtacaggaaataaagtaatatgaaaaacaccctgcgtgaactcaacggtgtgaacaggtcaagaataacacttcaaagtcatcttgccagccaggcgtggtggatcacgcctgtggtcccagcactctgggaggccggggcgggcagatcacctgaggtcaggagttcaggaccagcctggccaacatagtgaaaccccttgtttactcaaaatacaaaaattggctgggtgcgggtggtacatgcctgtagtcccagctacttgggaggctgaggcaggagaattgcttgaaccctggaggcagaagttgcagtgagccgagatcgcaccactgcactccagcctaggagacaaaatgagact

SEQ ID NO: 44101 - DNA, 447 bp, Homo sapiens
  misc_feature 8, 9, 35: n = A,T,C or G
ctttactnnttaagctgagacagcatgtttattgncaccttattgcaattggactatcctaattgaagaaattaaaaaatactctatcactctccacaagatgacagaggacaaatcaacaaattgaatagtgcaatgtgcattctgtcctgctttctttgatgtctgtaagaacaggattcaaaaattattttcatttctctcttaaactaatatggatatttaccatgataatattagatagaacctattctttgaaaatagagggctgggtcccttgagaatgcactttgtgagatccacccactgcccccaaaacattgctcttaactccaccgcctatcccaaaacctataagaactaatgataatcccaccacccttgctgactcttttttcagactcagcccacctgcacccaggtgaaataaacagccatgttcctccg

SEQ ID NO: 44102 - DNA, 276 bp, Homo sapiens
  misc_feature 2, 7, 34: n = A,T,C or G
cnaggtngctcatgcctgtaatcccagcactttnggaggctgaggtgggcgaatcatttgaggtcaggagttcgagaccaggctggccaacatggtgaatccccgtctctactaaaaattcaaaaaaattagccaagtgtggtggcgggcacctgtaatcccagctactgggaggctgaggcaggagaatcgcttgaacccaggaggcaagaggttgcaataagccaaatcgcgccactgcatttcagcctgggcgactgagcgagactctgtctc

SEQ ID NO: 44103 - DNA, 439 bp, Homo sapiens
  misc_feature 3, 4: n = A,T,C or G
atnncatgttcattgctttgtttgtagcatcaaagcaaaacaaaacaggaaacaatttgaatgactatagaggagaagttgaccaaattatgggaaatcgttatatgaggatattatgcaactaaacagaatttcttgacctgaaagagaatgtccatgatatagtgttaaataaaaaaaagagcaagttacaaggtaatttgtataatataaccctattttggtttgtttaaggaagtgaaacattgtttatgtgtatatacgagagcttttgctcaggagtagaaggatagattccaggctattagcagtggctacccaagagagtggaaagggaaaggagcagtgaagaggcaagttaaagccactgatatatcttggcattattttgcttgttacagtaaacagtcttcatcattcaaaaataatattttaattg

SEQ ID NO: 44104 - DNA, 486 bp, Homo sapiens
tagacccaggaggttttcaacctagtcacattatcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagacttta

SEQ ID NO: 44105 - DNA, 319 bp, Homo sapiens
  misc_feature 9, 32, 33, 35, 58, 59, 66, 77, 92, 131, 162, 209, 242, 275,293, 295: n = A,T,C or G
agaatcccncaaattatagcctggtgacaaanntnttcatagtgaattagtactcttnnaatactnctataattagntcatcaggaatttcntccacttcactgttataactgagaagactgtgctctgcngcttcagctaattcagcatcttcagtagctnctaaaaaataagcatcatcaatgccattatcccagacagcatcagcngatgcacctgttgacagcctgctaggtgatggnttatgaggattctgggtttcattgctcctagtntcatctgctgcatctggngnaaactcttcttcctttatttcagt

SEQ ID NO: 44106 - DNA, 306 bp, Homo sapiens
  misc_feature 2, 8, 178, 265, 295, 302: n = A,T,C or G
cngaggtncatattttcttttgtattcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggngatatatttgtttctatgaaaaatgtattgtgctttgatactaaaaatctgtaaaatgttagttttggtaattttttttctgctggnggatttacatattaaattttttctgctggnggataancctt

SEQ ID NO: 44107 - DNA, 498 bp, Homo sapiens
  misc_feature 25, 27: n = A,T,C or G
gagaagaaacacatctggtttggtntnaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggccccgagcaggaattcggtgtggacatagggccggtctgcttcttgtaaaaacctgaacccagaaacaacacaatccgttgcaaacccaaaggacccaagtactttc

SEQ ID NO: 44108 - DNA, 153 bp, Homo sapiens
  misc_feature 3, 6, 33: n = A,T,C or G
atnccnccactgtactccagcctgggcaacatnttaagactctgtcacacacacaaaaaaagataatccaccatgatcaagtgggtttcataccagggatgcagggatggtttaacatacgcaaatcaataaatgtgatacaccacataaaca

SEQ ID NO: 44109 - DNA, 495 bp, Homo sapiens
  misc_feature 1, 3, 86: n = A,T,C or G
nangccccatatgtctgcatatctttgtctttctatgcatatatattaaaccaggacttcaggatagcatcacacattaggttggngcaaaagtaattgtggtcctttccattaagtgtaaaactgcaattacttttgcaccaacctaatagtttgaggtaggggttgggtgggagagaaggagaatcaacttattaatatgctcatcaacatgtcatcttggttgtcttctccatcataattatcatcactatcatcatcgacatcatcatcaacatcatcactgctctaatgttcttattatgagccaggcactagatgacattatttaatgtaatcttcctaattatttatttgggtaggcttaattatcctcatcttatagttaacaaaaccatggatctgagagactgtccaactcatgcaagaacacccagttagtaaatgtcagagtgaggattcaaagccaggtctctctgatgtccaagttcatga

SEQ ID NO: 44110 - DNA, 138 bp, Homo sapiens
  misc_feature 10, 124: n = A,T,C or G
aatgtaaccntcattgtacaaaaattcccaacatctcttaatacaaatatggtacatttgacagtttctgaaacagattatttttaaaactttttaaaacctaagctttattttttttcctggntattagacacacac

SEQ ID NO: 44111 - DNA, 427 bp, Homo sapiens
  misc_feature 2: n = A,T,C or G
gngatccccattgttaggtgctgacctagtactgtagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcctattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttcca

SEQ ID NO: 44112 - DNA, 467 bp, Homo sapiens
  misc_feature 2, 6, 33: n = A,T,C or G
gnctcncttccgcctctttccgcgccgcctttntggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggaca

SEQ ID NO: 44113 - DNA, 475 bp, Homo sapiens
  misc_feature 404, 452: n = A,T,C or G
tgtaccagtgcattaatttgggccaggaaagtgtcataatttgatactgtatctgttttccttcaaggtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggnatgcttcaaaaattttgtaaattggttattttaaacttatctgtttgnaaattgtaactgattaagaattg

SEQ ID NO: 44114 - DNA, 134 bp, Homo sapiens
  misc_feature 2, 60, 61: n = A,T,C or G
anatccccaatttttaaaacttctacatgtatttttcacatgaagatctccttaacaggnngccaaccttttcttttataaaactattacatttaaaatatggacgtctgaaaaataaaatattcatcattttc

SEQ ID NO: 44115 - DNA, 470 bp, Homo sapiens
  misc_feature 3: n = A,T,C or G
agncccgaatgtgacttccaggaattctttgcctttgttgccatggttactactgcctgccacgagttctttgaacatgagtgagattagaaagcagccaaacctttcctgtaacagagatggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaaca

SEQ ID NO: 44116 - DNA, 382 bp, Homo sapiens
  misc_feature 6, 31, 365: n = A,T,C or G
aacacnccaaatgctgagagattttgtcacnttcaggcctgccctaaaagagctcctgaaggaagctctaaacatggaaaggaacaactggtaccagccactgcaaaatcaagccaaattgtcaagaccgtcaaggctaggaagaaactgcatcaactaatgagcaaaataaccagctaacatcataatgacaggatcaaattcacacataacaatattaactttaaatataaatggactaaatgctccaattaaaagacacagactgagaaactggataaagagtcaagacccatcagtgtgctgtattcaggaaacccatctcacgtgcagagacacacataggatcaaaataaaaggatagnaggaagatctaccaagc

SEQ ID NO: 44117 - DNA, 320 bp, Homo sapiens
  misc_feature 7, 8, 32, 33, 34, 317, 319: n = A,T,C or G
gagaatnnaaatgccctagcccacttcttacnnnaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacancnc

SEQ ID NO: 44118 - DNA, 292 bp, Homo sapiens
aaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacaccg

SEQ ID NO: 44119 - DNA, 481 bp, Homo sapiens
  misc_feature 35, 384, 434: n = A,T,C or G
aggctaacccgcagatatctcagtagaaacccttnttgccagaaaagagtgggggccaatattcaacattcttaaagaaaagaattttcaacccagaatttcatatccagccaaacaaagcttcataagcgaaggataaataaaatcctttacagacaagcaaatgctgagagattttgtcaccaccaggcctaccttacaagagctcctgaaggaagccctaaatatggaaaaggaaaactggtaccagccactgcaaaaacataccaaattgtaaagaccattgacattatgaataaactgcatcaactaacgggcaaaataactaactagcatcataatgacaggatcaaattcacacataacagtattaacctttaatgnaaatggggtaaatgccccaattagacacaggctggcaaatcggacaaagngtcaagacccattagtgtgctgtattcaggagacccatctcacacgc

SEQ ID NO: 44120 - DNA, 362 bp, Homo sapiens
  misc_feature 33: n = A,T,C or G
catgttgcccaggctcgtctggaactccggtgntcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttggaagaagataatattctaaaaatcatgccacctgaattgagcatttaggaatttatgtaacatttctatacaactgaattgcaaaaataaaactttaaattcaaactgt

SEQ ID NO: 44121 - DNA, 488 bp, Homo sapiens
  misc_feature 6, 31, 383: n = A,T,C or G
tcacangataactgttgaatcttacttctgncatgttttggtgctgaatctcacctcttaagtatttagagataccagatttcctctccttttaatgtagtagtgattagttatacctaaccattcttaagaacaaatcttagctattgatcatctcaatcataaactcttcaagatggctccctcaggagcttccttaaaacatctcatcctgagttaaaactatgccattttgaattttttaggatgattagcttcaaagtggacatgcacatggaaccagtgtgatctgttgcttaagtttatttagtattttcttgttaaatgttgggtctaccagatataacatttttagaacacattaatgtagctgataatattgnatctggtaatactggccaactgtttgagcctctttgaagtcttcagtgggttgatcaagataaaaccatgtcggctgggcgcagtggctcgcgcctgtaatccca

SEQ ID NO: 44122 - DNA, 386 bp, Homo sapiens
  misc_feature 16, 40, 42: n = A,T,C or G
ggccggggttaaggcnctggttgacagctcagactgaacntnccaccctctggcatgaggaagggaaggactgactctttctaagaagtggccgggtttttcccaagccactgtcacatgttcctggtccctgatgccagctgcatcatgcgcctacctgtgcacaagttcctacagcaaaagctgtgttcttggtggaagtaattaccaggactgcagctgacaatgtgagcacagtacggtcactcatacttttcaaattgttatggtgaggggcctttaaaaaacttcattggcgcactgaagtgtgtgccatcgtaagcactgagttcagtgaatttgaattcttataaagtgaacacaccacaagaccagcacccagacca

SEQ ID NO: 44123 - DNA, 372 bp, Homo sapiens
  misc_feature 7, 60: n = A,T,C or G
gtaggtnactaaaataatttgaaggcgatctttttaaaagagattaaaccgaaggtgatnaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtac

SEQ ID NO: 44124 - DNA, 247 bp, Homo sapiens
  misc_feature 22: n = A,T,C or G
tactcgggaggctgaggcgggngactcgcctgaggtcaggagttttaggaccagctgggccaacatggtgaaaccccatctctactaaaaatacaaaaattggctggacatggtggcacgtgcctgcagtcccggctactcagaggctgaggcaggagaatcacttaacctgggaggcggacgttgcagtgagctgacatcgtatcgctgcactccagtgtgggagtcagagtgagactccgtcttt

SEQ ID NO: 44125 - DNA, 100 bp, Homo sapiens
gaggtaggagaatggtgtgaacctgggaggtggagcttgcagtgagccgagatcgggccacttctctccagcctgggggacagagcgagactccgtccct

SEQ ID NO: 44126 - DNA, 306 bp, Homo sapiens
  misc_feature 7: n = A,T,C or G
ataatanacttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcaccgtctgtaataccagcttctcaggaggctgaggcacgaggatcacttgaacccaggaggaggaggttgcagtgagctgagatcatgccagggcaacagaatgagactttgttta

SEQ ID NO: 44127 - DNA, 468 bp, Homo sapiens
  misc_feature 7, 9, 274: n = A,T,C or G
gtttttnanttcgtttgggtggttatgtttgcttgcttaagccacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgntgggaataagcttacccactttctccttggtaaagcgtttacttaacaaaataatacccgagaatgtaaggtctctaagtcattactaacaaagagcaaaaataatatctgcagtattgtttttcccattgatttttaagtcagtttagagtacaaactgtatattaagaatttggcctgtaaaaatgaattct

SEQ ID NO: 44128 - DNA, 488 bp, Homo sapiens
  misc_feature 7, 33, 35, 214, 454, 456, 469: n = A,T,C or G
tagaganccctgtattcatgatacattattagntnggtctgaatataatgctttaatgattattacctttatacttttgcctttagaacattcagttgaatgttctgcatatttctaagtatgtagaaaatattttacaaattaaagatttcatagcaagacagctttcaacaaaaaagaaaggtttatttttttcctttctttattaattttnggaataatgaattggtattactgtttttcagccaaatccacatttcaaaagtagaagttaaatatcactttaatcccaatagaattttggggcaggctagtactcatttttggaagtcccttatattgagcccaaatacttagtctaatagcaaaagaccagacatttggtaggcaatcagtaaatgctttttctatgcattattgtaaatctattcattaaatttttcctggaaattgngnatctccatactgnctcttgctataaaattagc

SEQ ID NO: 44129 - DNA, 482 bp, Homo sapiens
  misc_feature 4, 33, 35: n = A,T,C or G
attntacacctcattcaaagggacaccatgggntntacttgttctcaatgcaattatttttgtgatgtttacagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagtaaccttttagagaatctcgctaagaaacatggagaaaacggaaaagaaaaatgtaatgcccttagaaagcgcaaagaaaga

SEQ ID NO: 44130 - DNA, 497 bp, Homo sapiens
  misc_feature 23, 25, 177, 259, 261, 305, 392: n = A,T,C or G
tgagtccagcagtcccatgaagncntttgcctttgaataggaagactctgacactaaagctaaatgatagtattgctggatgatgctccatcaaggcttcaaaaactcactaaccgtccaggggaaatacatgctaaggagttttgggacctccaattgaaaaatgagactttgctnatatatgttgatggcatattagaagccagcacaactatggcaaattgaccagaatattatactggctttacatttttttttngnctggatggggatccaaagtatccaagaaaaaaatcacaaatatngaaaaactcaattatatattttaggtttgaattttctcaggagcagagtaatctgctttcggactggagagaagctcttgtcagggnggccagactcaggacatggcagcagcctgtgaggggtttttaggtatggctgaatgttgccatatttcattttcttattttgggcttatagcaaaatgtctctat

SEQ ID NO: 44131 - DNA, 462 bp, Homo sapiens
  misc_feature 32: n = A,T,C or G
gttagcccaggaaaacagcatgtgggtatttnttgaccgaaatgatgccaatttgtaaattaaaatgtcacctagtggccctttttcttatgtgttttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctaga

SEQ ID NO: 44132 - DNA, 363 bp, Homo sapiens
  misc_feature 212: n = A,T,C or G
gaacaaccccaacaaaaaaggccttttgggattttggatgatattgcatcaaatccatacattaacctgagagacgagcgacttcttcaacattgagccttccaatcatgattttcaattcatttaggtcttctgtaatgtttcttaatataattgtatttgttgctatgcagaagtttcactgatcttttattatatctctatatatattngatatttctgacactattgtaaatagtatctttttaatatttcattttccttttttgttgcttaaatatatataaaataagctaattttccaaactaatttttatatccagcaaccctgctaaaatttcttatccaataaaaatataaatg

SEQ ID NO: 44133 - DNA, 475 bp, Homo sapiens
  misc_feature 7, 33: n = A,T,C or G
gattccncaagctgacagcattcgggccgagtnttctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaggatagttaagtgggatcgagacatgtaagcagcatcatggaggtttgaagatgccgcatttggattggatgaattccaaattctgcttgcttgctttttaatattgatatg

SEQ ID NO: 44134 - DNA, 458 bp, Homo sapiens
  misc_feature 2, 32, 56, 58, 73, 141, 178, 212, 213, 264, 291, 365: n = A,T,C or G
gnacccgctggagacgtgtggagctgtttttngactcgcgggtgtgcagggcaccncntgatatgtgttttanaaatagccgttaaactttggtttgaatgaagaatgtctctcaatccacctatatttctcaaacgaagngaagaaaatagttcaaaatttgtggaaacaaaacagncacaaactacttccatagcttcagaagatccccnncaaaacttatgtttagcatctcaagaagttcttcaaaaagctcagcaaagngggagatcaaaatgtctcaaatgtggnggttccagaatgttctactgctatacatgttatgttccagttgaaaatgtacctattgaacagattccacttgngaagcttccattgaagattgacatcattaaacatccaaatgaaacagatggcaaaagtactgctatacatgcaaaactcttagcacctgaatt

SEQ ID NO: 44135 - DNA, 119 bp, Homo sapiens
  misc_feature 23: n = A,T,C or G
gaagcatcttccagaagtgtganctgggaataaatatgcctctcctttgtatattatttctaggaagaattttaaaaatgaatcctacacacctaagggacatgttttgataaagtagt

SEQ ID NO: 44136 - DNA, 437 bp, Homo sapiens
  misc_feature 111, 180, 185, 232, 279, 349, 389: n = A,T,C or G
tgagggggcaggcggagcttgaggcaaccgcagaataagtttttttctctttgaaagatagagattaatacaactacttaaaaaatatagtcaataggttactaagatatngcttagcgttaagtttttaacgtaattttaatagcttaagattttaagagaaaatatgaagacttagangagtngcatgaggaaggaaaagataaaaggtttctaaaacatgacggaggtngagatgaagcttcttcatggagtaaaaaatgtatttaaaagaaaatngagagaaaggactacagagccccgaattaataccaatagaagggcaatgcttttagattaaaatgaaggngacttaaacagcttaaagtttagtttaaaagttgtagggngattaaaataatttgaaggcgatcttttaaaaagagattaaaccgaag

SEQ ID NO: 44137 - DNA, 310 bp, Homo sapiens
  misc_feature 176, 177: n = A,T,C or G
aggtgcagatcacagggcatactaccttccccaacaccagcaggtcccctagtccactaggtctgggagccgggagtggcagcaggaaattttgaatggcttatgagtctccagtatgaggagttgtgcatgggtctgggaggagcctgctacccccactaatgccctttctgttnnccattccatctgcttccactcctggattatgagtggtggaactgaaaggcacgggacacgggaggtggagtttgcagtgagctgagattgtgccactgccctccagcctgggcgacagactgagactctatct

SEQ ID NO: 44138 - DNA, 500 bp, Homo sapiens
  misc_feature 10, 26, 51, 228, 482: n = A,T,C or G
gtacaatatnatggagctcctttttnctttctccactaattgcgtgatganctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggngaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtaggggtttgtttgtttgttttttaaagcaaatgatttccatattcctgattgatcttttttgncatctttgcttcaaaatt

SEQ ID NO: 44139 - DNA, 274 bp, Homo sapiens
  misc_feature 31, 34: n = A,T,C or G
ctcccccaagtgcaaagagtgcaaatgcacnttnctgcaagaagagctgctgttcctgctgccccgtgggctgtgccaagtgtgcccagggctgcgtctgcaaaggggcatcggagaagtgcagctgctgtgcctgatgtgggaacagctcttctcccatatgtaaatagaacaacctgcacaacctggatttttttaaaaataaaacactgagccatttgctgcatttctttttatactaaatatgtgactgacaataaaaacaattttgacg

SEQ ID NO: 44140 - DNA, 500 bp, Homo sapiens
  misc_feature 485: n = A,T,C or G
agtgtatacagtcccttgattttaccagaagatgggaaagagagcttgctttgattttcttcctgtaatccagatgaaggtttagagacgggcagctgtgaagccttcagcaaaggtctgaacggaaagaaccttgctttcaaagatacatggatttagaggaaaagcggtgcagttcatatgtatggtactaggaagactagcttcagagtacctgtttggttgctgcatggtgggcacaattccacatctccctgtgaggctgggggaggggaagtaaatagcaaaaaaacaaaaaagacattggaagagattttcctcctgtcatctgtgatgaggagtggcaaccttgctggttagtagataatcagcctacagaagagagctgccttctattgctcacaagtttgtttccgctcaagagtatcccacaatttgatttatgctaaatggggagtgagtggacaaagaagaatatctaaggnaacctaaagaaaaat

SEQ ID NO: 44141 - DNA, 296 bp, Homo sapiens
atatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttgggatttaagaaataacttgtgttactaatttgtataacccatatctgtgcagtggaatataaatatcacaaagttg

SEQ ID NO: 44142 - DNA, 466 bp, Homo sapiens
gggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaactttacatactagaggcaggaaagcaccgagctgacaagtcaactctaagcacttatctagaagactgtaaatttgacagagagcgaatagaactgttttgcacggaatatcagaataataagaattccctagaaatcctactgggaaggtaggtacttgtataaggtgtcaagctgaggcactttttcacttgcaggtatgaatggagagtgttggtgtgagacaagatcttcgggatcttgacccaaag

SEQ ID NO: 44143 - DNA, 278 bp, Homo sapiens
  misc_feature 277: n = A,T,C or G
ggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattnt

SEQ ID NO: 44144 - DNA, 471 bp, Homo sapiens
gggtgggattcaggaaagggagatgctggtcctgcttcctaacctggtctatgagctgaattactcagtgagaggtgatgtaattccttgagacacacgccagagacatggaaataaataaagctgctcttctcctctcattggaagaggtcatgctgacggagttatgcaggattcttcggagaagggaacccaggaacttgatatcaatctcattatataaagacaccacagaatctctttgaatgtaggattctgttgacgcacagtgtgccattaaattggaaacaggaatgagtaaggcagttgcaaatcacaaagcatttaagccactttcacccccctctgcttgctccaatatgagcatgtaaccttactttgttcaatgacatttggcagcccgccaaccctcaaagccatttttatttttatttttcatctctgggttcaggaatgcaccagaagcttatc

SEQ ID NO: 44145 - DNA, 192 bp, Homo sapiens
  misc_feature 7: n = A,T,C or G
accaagnaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagagtc

SEQ ID NO: 44146 - DNA, 187 bp, Homo sapiens
  misc_feature 167, 187: n = A,T,C or G
acattgctaagataatgacattgattatctgtgaggagtcacagataggtgaacatttttgtttgcctaatatctttgaatgatagaaaattttagttttggttataattttgaatgagttggaaaacagacaaaacactgttctatttttttttttgagactgggnctggctctgtcactcaggtn

SEQ ID NO: 44147 - DNA, 330 bp, Homo sapiens
atattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcac

SEQ ID NO: 44148 - DNA, 192 bp, Homo sapiens
  misc_feature 192: n = A,T,C or G
gagggattttttaattttaagctatttgtctgttaagtatataataccaaaacgcaggttgtttaaattaggatttccaagtaatttacgtcgtcttcaaaattcctggggtctatcaatcagaaacgccagaaagtttgtgtactagtttcacattgttaagggagtatctataataaaattcaaatgcgn

SEQ ID NO: 44149 - DNA, 426 bp, Homo sapiens
  misc_feature 42: n = A,T,C or G
aactcacaaaattctcacttctgttaagaaagggccttgccntggttgacggggatttgcacttcaccgtgtggacagtgacagaatgcgtctccccgcccctccttacctggcaaactttgtcattacctccgcccagggacctcctaggcattctcctctggactccctcagccctcagccttctcctcctcccggtaccagctaggtcagacaagacctggagcagagaaggtgcccagtaaagcctgatgagttcttgaatgatcaagtgaaagccctcaggtatccagatagttcagttggccagaaagcccatttttctcagattttactcagctatgtttgcttgttcagcatatagaatcctttttattttttattacttcattttattttgtagaaactgggtgatagagcaagact

SEQ ID NO: 44150 - DNA, 419 bp, Homo sapiens
aatgaaggtggacggagaggtgctgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgccgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgat

SEQ ID NO: 44151 - DNA, 472 bp, Homo sapiens
attgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagcagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgct

SEQ ID NO: 44152 - DNA, 159 bp, Homo sapiens
ggatatctcctaggagctcctcctagggtttttcacaggctgtctcattccttaggcttcctgcattttaccatgaagggcccacctaacctgtatgcattgaaggactgaccttgttttttagccattattgaggtctccaaattcaactcagtccca

SEQ ID NO: 44153 - DNA, 256 bp, Homo sapiens
cagggatgggctcatactcactgcagaccttaactggcatcctcttttcttatgtgatctgcctgaccctagtagacttatgaaatttctgatgagaaaggagagaggagaaaggcagagctgactgtgatgagtgatgaaggtgccttctcatctgggtaccagtggggcctctaagactaagtcactctgtctcactgtgtcttagccagttccttacagcttgccctgatgggagatagagaatgggtatcct

SEQ ID NO: 44154 - DNA, 472 bp, Homo sapiens
gaaactacctccttttaaagccctgggagaggatggattacaatgctggcacacctgcactagatgacatcaccaggtaattatgccccgccctacctggagatagtactttgaaaagaacttgctttacagatcatttggtctggtgatccagccttctctcctttaaggatagcaaggatcctttttcttaataaaccaattattttgaaagcttatagcgccataacattctacatttattaataattaatttatccacttgtttttgccaatcaaggccatatgtataaacatataatgaaacaaaaacagtgaacaaatagtaaacagtgatcaaaattgggctgggcttggtggctcaagcctggaatcctagaactttgggaagccgaggtgggaggattgcttgagcccaggagttccagaccagcctgggcaacatggtgagaccttgtctctacaaataata

SEQ ID NO: 44155 - DNA, 396 bp, Homo sapiens
gagaggcgtacaggcccttcccgaccgtagcgagggtgctgctgcgctggaggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagc

SEQ ID NO: 44156 - DNA, 470 bp, Homo sapiens
  misc_feature 22, 24, 423: n = A,T,C or G
ggaggatcacttggacccaggngnattgaggctatagtgagccatgattgcacctctgcactctagcctgggtgaaaaagtgagactgtctaaaaaaaaagaaaagaaaggaaaggaaaatgcctgttgtctctcctctgcaaatgagctgatactgaaaggtaatctggaacaggagttttatggatatctgtttttgaaactgaaagaagtagcattttggcatgatctggagctgacatacattccagaggctatatagatgatgacatctaccagtgaggctacatgactgacgtagaaactgaggttctttcgctagtctaggacaaagatgaagcttaacttcactgatggatagaaccagactttgtcactgtttaaataatacatttttggttgttttctaaatatgaattcggntcactctgaaattagagcagttccatgagttcactgaatttatttga

SEQ ID NO: 44157 - DNA, 470 bp, Homo sapiens
  misc_feature 39, 102: n = A,T,C or G
ggtagcatcgcggagtcggtgctttagtacgccgctggnacctttactctcgccggccgcgcgaacccgtttgagctcggtatcctagtgcacacgccttgnagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagct

SEQ ID NO: 44158 - DNA, 347 bp, Homo sapiens
  misc_feature 13: n = A,T,C or G
atttattttagtncggtctcactttgtcgcccaggtgggaatgcagtggtgagataatagctaactgcaaccttgacctcctgggctcaagaaatcctcttgcctcagccccctaagtagctgggactacaggcgcgcaccaccatgcccagctaatttttgtactttttgtagagaatgggttttgccatgttgtctaggctggtcttgaactcctaggctcaagcaatctgcccatcttgggctccccaaagtgctgggattatagtcggcatgagccactgtgctgggcctaacccattatttttgaatcagatagtgttatagattccatttcaatatatttg

SEQ ID NO: 44159 - DNA, 218 bp, Homo sapiens
gtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacccttgcgcagaaatcaagatgagattggcatggctttatttgttttttttgttttgttttg

SEQ ID NO: 44160 - DNA, 194 bp, Homo sapiens
gtcggagcactgagctccacccttttctgagagttatttacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaat

SEQ ID NO: 44161 - DNA, 422 bp, Homo sapiens
gagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatcaaggaaatagcgtggaactaaaaattctagaccatctcagcaaaatcctgaactaggattgcaggcattcagatataaaattcctctaaaaatttcgtctttgttggtgtgggactggggggcatggttatttagtttggatgaaggtttaattaagagtgttagaaatggcaggtaactact

SEQ ID NO: 44162 - DNA, 464 bp, Homo sapiens
gggagtgaaacctcgaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgata

SEQ ID NO: 44163 - DNA, 212 bp, Homo sapiens
  misc_feature 8, 121, 123, 157, 170, 176, 192: n = A,T,C or G
tggaccgnggtccagacatggagaagccccgtctctgccaaaaatacgaaagttggctgggtgtggtggcgggtgcctgtagttccagctgctcgggaggctgaggcaggagagttgcttnanacccagggggcagaggttgcggtgagccaagatngcaccattgcganactctntctgagacaagaaganagactctgtctcaaaaaatt

SEQ ID NO: 44164 - DNA, 436 bp, Homo sapiens
gggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccacgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtgtaagtcggggctaaaggaagcgggaattgactttcttaagctttgttttgattacagtgtaagatg

SEQ ID NO: 44165 - DNA, 256 bp, Homo sapiens
tcggaaaattgaggaaatcaaggacttcctgctcacagccccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 44166 - DNA, 172 bp, Homo sapiens
  misc_feature 22: n = A,T,C or G
cactccagcctgggggacaagnagcaaaacttcttctcaaaaaataaacaaataaataaataaataaactcttgacctgaaagatatatgctccgttttgactaatataaaattgattagcagagttagttgaaatcattacagcacccaggggcagctggattgctttcat

SEQ ID NO: 44167 - DNA, 460 bp, Homo sapiens
cggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgag

SEQ ID NO: 44168 - DNA, 460 bp, Homo sapiens
ataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgt

SEQ ID NO: 44169 - DNA, 471 bp, Homo sapiens
  misc_feature 209, 263: n = A,T,C or G
agcaggagcagtggctcacgcctgtaatcccagcactttgggaggccgaggggggtggatcacctgaggtcaggagttcaagaccagccagatcaaaacagtgaaaccccgctatctactaaagatacaaaaaactggccaggcgtggtggagaaaaatacctgatcatctgcaaatgtaacaaaggcaaaggccctgaatggctcggngatgaagacatccatcacatccccgtactgagagaagaactcccgcagctcatnctcagtcatgtcctctgtacagcgccccacaaacacttttctgcttctcaaaggctcatcttggctttgctgatcaaatcaaaaggaagaaaaaaactcagaaatatgttatgaacaatgaaaaaaacattaaggtaaggggatataacaaaatcattcgccttggatagcagtgaaccattaaaaagtagacgtacccttaattttt

SEQ ID NO: 44170 - DNA, 384 bp, Homo sapiens
gtatcttccgtttagtttctcaattcatccaaaaccgtatccaggccatcaccaatcattctatatgacaaatgtttcttctaacaaccccacaataccaccccttaccacaagatctcccttcagcttaatttctcccactctaggttcccacgctgcccctaatcccgcttgaagcagccctgagaaacatcgcccattctccctctccataccaccacccaaaaattttcgccaacccaacacttcaacactgttttgttttattcttcttattaatataagaaggcaggaaagtcaggcctctgagcccaagccaagccatcgcatcccctgtgacttgcacggatatgcccagatggcctgaagtaactgaagaatcac

SEQ ID NO: 44171 - DNA, 120 bp, Homo sapiens
gaatgatatttcctattcgcctacacaattctccgatccgtccctaacaaactaggaggcgtccttgccctattactatccatcctcatcctagcaataatccccatcctccatatatcc

SEQ ID NO: 44172 - DNA, 289 bp, Homo sapiens
ggtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 44173 - DNA, 439 bp, Homo sapiens
  misc_feature 84: n = A,T,C or G
gctttccaacttggacgctgcagaatggctcccgcaaagtaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattg

SEQ ID NO: 44174 - DNA, 444 bp, Homo sapiens
  misc_feature 365: n = A,T,C or G
agaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggnggtttcctgctggcctggaatcactcatcacctgattgattggctctgtggtcctgggcaggtgcctcataggtgtgtg

SEQ ID NO: 44175 - DNA, 425 bp, Homo sapiens
  misc_feature 239: n = A,T,C or G
gtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtacttggcctgtatgtacatggggtccttcaactgaggccttgcaagtcaagctggctgtgccntgtttgtagatggggcagaggaatctagaacaatgggaaacttagctatttatattaggtacagctattaaaacaaggtaggaatgaggctagacctttaacttccctaaggcatactttttctagctaccttctgccctgtgtctggcacctacatccttgatgattgttctcttacccattctg

SEQ ID NO: 44176 - DNA, 276 bp, Homo sapiens
tgcaggggctcacacctgtaatcccaacacttcgggaggctgagataggtggatcacctgaggtggggagtttgagaccaccctgaccaacatggagaaaccccgtctctactaaaaatacaaaattagccaggcgtggtggtgcattgcctgtagtctctgctactcaggaggctgaggcaggagaatcacttgaacccgggaggtggagtttgcagtgagctgagatcgtgccactgtactccagcctgggcaacaagagtgaaactccgtcgc

SEQ ID NO: 44177 - DNA, 400 bp, Homo sapiens
  misc_feature 3, 10, 27, 42, 52, 56, 135, 160, 165, 207, 291, 343, 391,394: n = A,T,C or G
acnggtatanaggcgctcaggcccttnccgaccgtagcgagngtgctgctgngttngaggaaggaaaacgccgctttgactgtgccttgttctcacagctggcgggaagcaagcgcctttttcgaaagccagagnctcgagttacccctcttaccaccgncatgncagtcccaggttgcaacataggacagtgtcagagcaggctgnaaaaaatgtggctaccctggtcacctgacttttgaatgccgcaattttctccgagtagaccctaaaagggacatagtttttggntgtcagcaggtacaagtggtgaagatagcgatgaagagaatgaagaactgantaaattgcaggcattacaggaaaaaagattaaatgaagaagaggaaangangaaaga

SEQ ID NO: 44178 - DNA, 456 bp, Homo sapiens
gaatgatgtaaattttaggtccagttgaacaaatattgagtgcctatcatatgcaagactaactccttactgggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttat

SEQ ID NO: 44179 - DNA, 466 bp, Homo sapiens
gcaaaaatagcattgcatacatggatcaggccagtggaaatgtaaagaaggccctggagctgatggggtcaaatgaaggtgaattcaaggctgaaggaaatagcaaattcacctacacagtcctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccac

SEQ ID NO: 44180 - DNA, 286 bp, Homo sapiens
agagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 44181 - DNA, 355 bp, Homo sapiens
agttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggccgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctacca

SEQ ID NO: 44182 - DNA, 242 bp, Homo sapiens
ggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaggagagagtaaaaaatttaacacccatagtaggcctaaaagcagccaccaattaagaaagcgttcaagctcaacacccactaccta

SEQ ID NO: 44183 - DNA, 461 bp, Homo sapiens
agggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttg

SEQ ID NO: 44184 - DNA, 110 bp, Homo sapiens
gaatgagtgattaaataaatgttaaatgtcaatatgtatttgtaatctgttaacttctgtcttgtaagtagtgataaaacaagacattaaccactcaatcaacattcacc

SEQ ID NO: 44185 - DNA, 182 bp, Homo sapiens
  misc_feature 14: n = A,T,C or G
caagaatacttatnaaaaatttcttggctgactttcttattggccagaaagacttctctgcaattcttacttggtgacttaagatatcagtgaagtggttaaaaatttagtttaaaaagttggctttaacaagtttgcattttttgttgcccaggaaaacataacttaagattgcaatatct

SEQ ID NO: 44186 - DNA, 453 bp, Homo sapiens
  misc_feature 19: n = A,T,C or G
gtggcaagcattatacagnaggggccatagtctggaaagcaggagatgcttacagacatataagttgtttccagtgttttgctcttggtactcatggttccactatttacatcaaccttttgagaaacatatttatacactgtcttatacttccctcctttgctacagaatgaatctacttgtaacctaccaaaaatttaccctgtcacatttccccagctgctggtttaaaaataaatatcctggatttaaagccaattgtgtctaacaggtgccaccatccaagtgaggatttcactgttcacaggcatttgagacacaccagcggccggcggttctcactgctcttcatatggaggcaaccatatatgggtaagtcatttagtctcttaggtaggcgaactgaggccaatctccccacttttagggctgtgaaactgttctgtatgatac

SEQ ID NO: 44187 - DNA, 136 bp, Homo sapiens
atgtaaggttttttttgtacgcaattctcgattctttgaagagatgacaacaaattttggttttctactgttatgtgagaacattaggccccagcaacacgtcattgtgtaaggaaaaataaaagtgctgcccgtg

SEQ ID NO: 44188 - DNA, 424 bp, Homo sapiens
attacctgagggtacctgtggggaacagttccttcccctgtgtggtagtattttgttggaagagaatgtttatacgaaaaatgaaattcttccaacagcagagaaactctaaaaagtttgatagtacctatcaaagtgctgtacttctgtgatagagaacatctgatgtaccaatttagatctatttctttatactttttctaaccaattgcttaatagtactttggatgattatcacctttgccacttaaaatatataaatatcctttttacttcatgaggaaggaggaattttttgataattactgagttcagccttttgtgatgacttatattttggacttacattttaactttaaagaatgtcagatcccttctttgtcttactagttaaatcctcacctaatctcttgggtatgaatat

SEQ ID NO: 44189 - DNA, 465 bp, Homo sapiens
aataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaaccttgatgttttctatcagcataaataaaatggtcatgaatagtcatt

SEQ ID NO: 44190 - DNA, 127 bp, Homo sapiens; identical to SEQ ID NO: 29974

SEQ ID NO: 44191 - DNA, 431 bp, Homo sapiens
  misc_feature 425: n = A,T,C or G
agacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggnggaaga

SEQ ID NO: 44192 - DNA, 229 bp, Homo sapiens
atttgactgtaatttgcacatggtgaaaacagagtttgctactagtgtctagtaatttaaaaacgaaaacctgtttttccagagtcagaagaagacatcctaggcctatagaatcaaatttgacaactaatttgtagcataattattttcccatgctttatgcatatttattgattgatgcagtctcttgaattatacctagaagcaaactgaccagcggatcagcaca

SEQ ID NO: 44193 - DNA, 335 bp, Homo sapiens
acaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgt

SEQ ID NO: 44194 - DNA, 100 bp, Homo sapiens
  misc_feature 20: n = A,T,C or G
attgttaactagcctaatcngtggctaaactgccgtaggttgaaatcagtcctggtaagattatttacatcaggggactcattcaacaattcacatcagg

SEQ ID NO: 44195 - DNA, 409 bp, Homo sapiens
  misc_feature 48, 89: n = A,T,C or G
ctatgataatgcagtagagaaataggttgaaagacttcttcaaaaatnacttacatcccagttaccctgatttgatcattatgcattgnttacaggtattaaaatgtgacatgtaccatgtaaaatttttatatatcaataaaacagtaacctgagaaaaaagtaaataaaatgagtgagattataaaaaaactacttaactatttagacatagactcaggactaagctagttgcttcagtaagtgctaaataatatactattatatgtaacaatattactggctgaagttgtaatgagattcaaggtgagtcagtttctatcttctccttctttctctttatctcctttcttccacccccacccccatttagagacatacacctctgcaacattggtctgttttatat

SEQ ID NO: 44196 - DNA, 441 bp, Homo sapiens
gggaaaggaaggggaggtcatatggatcatataacactaatgaagatatggaccctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgttttttgtggtttgaagtttagtttaatgttagtgcagtgacgggaaatacacattatgctaatgttgatgacaga

SEQ ID NO: 44197 - DNA, 369 bp, Homo sapiens
cattaagtttaatttgaagtgttcttttaacattctttaaccagccaaactgcaagtgaatgtgaggacatcataaagacattttaagacacacaaacagattcaaaaagtttataattcactgtccacatagagtaacctttctcaacagggtaccactggcatttggggtggaacaattctttattgtgtaagactgatccacacattgcaggttacttagtgtccttgaccatcatccattaaatgccagtagcatttctcctccccgtgacaatacacagcagccccacatttggagggggtgctgtatcacctctggttgagaaaccatggtgtagaaaatatattcaaagagaaaataaatct

SEQ ID NO: 44198 - DNA, 282 bp, Homo sapiens
  misc_feature 35: n = A,T,C or G
gacagctgccatgggcaagaagaagatcgccaagnagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattat

SEQ ID NO: 44199 - DNA, 168 bp, Homo sapiens
  misc_feature 32: n = A,T,C or G
cattgagcagttagctcatttgagataaagtnaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 44200 - DNA, 457 bp, Homo sapiens
acagagtatgtgttctaaatgttctaaagtaggtctttattaccaagtgactgtacaatattgcaattgccattaagaatgatattgacattaatgtatagttttattgctaataattcttttattttcaaattttctgtttagaaaaatatcatttgaaaaaatacagtttacttaaatatttcccgattatttgcagagggtctaaagagagtacttaccggtaatcagtggctctttattgcctttattttggaaaaaaaaatagaactttctttggtagatttatttctcaacccatttaatgtggtttagagtaaattcgtcatttaaaattttattttaaattatttttatttgtaggatgagctttctgatgttagccaaggcggatctaaagctaccactccagcatcaacagctaattcagatcggggcaacaattcctactgatact

SEQ ID NO: 44201 - DNA, 471 bp, Homo sapiens
gttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttcttgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttc

SEQ ID NO: 44202 - DNA, 490 bp, Homo sapiens
  misc_feature 7, 30: n = A,T,C or G
gaacttngcaaagtctcaggatacaaaatnatgtacaaaaatcacaggcattcttatacaccaacaacagacaaacagagagctaaatcatgagtgaattcccattcacaattgcgtcaaagagaataaaatacctaggaatccaacttacaagggatatgaaggacctcttcaaggagaactgcaaaccactgctccaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacacaattggaaaaaactactttaaagttcatatggaaccaaaaaagagcccgcatagccaagtcaatcctaagccaaaagaacaagctggaggcatcacactacctggcttcaaactatactacaaggctacagtaaccaaaacagca

SEQ ID NO: 44203 - DNA, 239 bp, Homo sapiens
  misc_feature 198: n = A,T,C or G
tctgaacacttccttgttatgccacccagtaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcanagaaactattaaaggtattcagaaacgtgaagccagcaatt

SEQ ID NO: 44204 - DNA, 389 bp, Homo sapiens
gtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcag

SEQ ID NO: 44205 - DNA, 142 bp, Homo sapiens
ggggaataagcataaccctggattcttactactgatgagaacattatctgcatatgccaaaaaattttaagcaaatgaaagctaccaatttaaagttacggaatctaccattttaaagttaattgcttgtcaagctataacc

SEQ ID NO: 44206 - DNA, 247 bp, Homo sapiens
  misc_feature 246: n = A,T,C or G
aggagcatcttcagcaaggaaggaaggttctgacagacaatggaactacgcctgcatgcccacaccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatnt

SEQ ID NO: 44207 - DNA, 315 bp, Homo sapiens
  misc_feature 22, 52, 106, 219, 274: n = A,T,C or G
gaggcattgaggcagccagcgnaggggcttctgctgagggggcaggcggagnttgaggaaaccgcagataagtttttttctctttgaaagatagagattaatacanctacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaattgag

SEQ ID NO: 44208 - DNA, 338 bp, Homo sapiens
  misc_feature 28: n = A,T,C or G
atttacaatataggaaagaaagccaagnatttaggtaatgagtggatgagtaaatggtggaggatgggagtcaaaatcagaattatagaagaagtatttcctgtaactatagaaagaattatgtatatatacatgcagaaatatatacgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctgc

SEQ ID NO: 44209 - DNA, 267 bp, Homo sapiens
  misc_feature 206, 229, 236, 240, 266: n = A,T,C or G
gggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctgcaatccctctttaaataatcctagggaaaaaagnaaggataaaggcttacatttttncccaagntttngggtcttaaaaccctttccccaaaang

SEQ ID NO: 44210 - DNA, 114 bp, Homo sapiens
  misc_feature 9, 27, 29, 43, 78: n = A,T,C or G
acactcccnactcgtggccctctgacnangtggcgggccctgnactcatgagggcttccaatgtgctgcccccctctnaatactcaccaataaattctacttcctgtccacctc

SEQ ID NO: 44211 - DNA, 110 bp, Homo sapiens
atggccggggagtaagaaggaggagtctgaagagtcagatgatgacatgggatttggcctttttgattaaattcctgctcccctgcaaataaagcctttttacacatccc

SEQ ID NO: 44212 - DNA, 372 bp, Homo sapiens
atgatatatgtgaattattttatgcgcagattgtgttttgggattgtcagatctaaacttatattcttgctggctaatgtgctgatagccaggtctgaaacttgatgtgctatccagacacatatgatcagaaaagatctagagtgcaaagaggtgcctgaggagcaaaatgtggttttaatgttgtggaaagatcacttgcaagtatataagactgtataaagaagaggactgtgtgcaagtggggtgaaaaaaaaggatacgcgaatgtgcatatgactgaatagggaggaaggtcagggctagaaaggaggctacataaaaaggggcaatggagagtgcacaggaaagacacaggggaaggtcaagtcg

SEQ ID NO: 44213 - DNA, 491 bp, Homo sapiens
  misc_feature 4, 17, 30, 209, 211: n = A,T,C or G
gggngcccctctgtggntgtcgggacatgnttaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagatncncctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatggctctcaaccactttgtgaatacatatgtgtat

SEQ ID NO: 44214 - DNA, 405 bp, Homo sapiens
  misc_feature 11, 23, 168, 169: n = A,T,C or G
cttctttcccngggaattcggtnttatggcctgggccgctataaacatacgtgtgcatgtgtctttatagcagcatgatttataataaaattttcaaagtagccagagagaaacaacacattccctacagagaatgactgtgggtttctcttctgaaactgcggcagnnggaaggaagtagtatgttttctcaagtactgagaggaaagcactatcaaataaaaatctgtatcttttgaaactatcttcatgaataaaggggaactaaaggcattattagacagggaagctaagagaaaatgttgctagcaaacctacctttaaaaattggctagaagttctctaaatagaatggaaataacacaagaaggcttggaatgcaggcaagaaagaagattggaggtt

SEQ ID NO: 44215 - DNA, 465 bp, Homo sapiens
gaggaggggaagcagagggacgatgaggtgcggaggcgttggcagttgacttttgctgatggagcctctctgaagggcaaattcaaagtacagctgggtgctgcagcactggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggaggtcatgtgagcacacagcataaaggcagctgcccacaagccaggaagagaagcatcatcagaaaccgaccatactggcttcctgatctcagactttcagcctccagaatgattattgcctgctcctccaagcccttcactgtagaatggaagcctgtgattttcctggcatcatgcatgactgagaaggtcagt

SEQ ID NO: 44216 - DNA, 113 bp, Homo sapiens
gctacttgggaggccgaggcaggagaatcacttgaacctgggaggcagaggttgcagtgagccgagattatgccattgcactctggcctggcgacagagcgagactccgtctc

SEQ ID NO: 44217 - DNA, 327 bp, Homo sapiens
  misc_feature 90, 151, 175, 192, 209, 212, 303: n = A,T,C or G
gactctagagatgccacctgcactgtgattataactgtcaacactacatggagtgctgccctgatttcaagagagtctgcactgcggagntttcctgtaaaggccgctgctttgagtccttcgagagagggagggagtgtgacttgcgacncccaatgtaagaagtatgacaagngctgtcccgattatganagtttctgtgcagaagngcntaatcccacatcaccaccatcttcaaagaaagcacctccaccttcaggagcatctcaaaccatcaaatcaacaaccaaacgttcacccaanccaccaaacaagaagaagactaag

SEQ ID NO: 44218 - DNA, 402 bp, Homo sapiens
gatcctggccccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccccataaagacaaaccaatcaaccatgacaaaggaagttgacctgaacatgtaaccatgccctaccctgttaccttgctagctgcaaaataaacttgttgctgacctgctgtgctcgcaga

SEQ ID NO: 44219 - DNA, 466 bp, Homo sapiens
ggtggatgccacactcaagtccctcaacaaccgattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccatggaaggctcccagaacatcacctaccactgcaagaacagcattgccttatctggacgaagcagctggcaacctcaagaag

SEQ ID NO: 44220 - DNA, 313 bp, Homo sapiens
  misc_feature 48: n = A,T,C or G
caccaaggtcctgggcaggaccggttctcagggacagtgcacgcaggngcgcgtggaattcatggacgacacgagccgatccatcatccgcaatgtaaaaggccccgtgcgcgagggcgacgtgctcacccttttggagtcagagcgagaagcccggaggttgcgcttgagctttggctgctcgcttgggtctttggatgtcggggttcgaccactttggccgatgggaatggtctgtcacaatctgctccttttttttgtccgccacacgtaactgagatgctcctttaaataaagcgtttgtgtttcaagc

SEQ ID NO: 44221 - DNA, 475 bp, Homo sapiens
ggagtttggggcgcggactggagtaccttgcgtgcagttatgtcggcgtcggtagtgtctgtcatttcgcggttcttagaagagtacttgagctccactccacagcgtctgaagttgctggacgcgtacctgctgtatatactgctgaccggggcgctgaagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgactcattctcatttacttaattgaggagtaggagactaaaagaatgttcactctttgaatttcctggataagagttctggagatggcagcttatt

SEQ ID NO: 44222 - DNA, 382 bp, Homo sapiens
tcaggtcataaagttcaccagatgaaaatacaacactatatctctataaatataaagaaagatttcagtaaaatctatattccttcacatttttgacaattaaatttgtataaagatgcagaaatagacacattttttgaagaaaaacatttggaaatataagcaacattcagctcatagatataaagaatttctcacagacataaacacggtccttaaggaaagctcaagggtaagccccagggaaggcatgtttctcaatgtggtcatgaaaaccatgcttgaaagtttccatgggatgtgggtcaacctgcacacacagaaaaccaaccatgtcaagagaacctaagaaagtcaaaattggataagcagccatgcacag

SEQ ID NO: 44223 - DNA, 246 bp, Homo sapiens
  misc_feature 18: n = A,T,C or G
cacatttggatgattgtnctaaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgcg

SEQ ID NO: 44224 - DNA, 408 bp, Homo sapiens
gattgtacaagtagtttgagtataagaactgctgttgggaaatatgtactaggtatattggaattcagagaaatgcctagtttagtctggagtgaagggtaagttaaggtttcccacagtttgtttcagtgtaggcctgagactagtagctatgtgtgcagaaggcagtagggatatagttattctgtcagtctgtctaatatctgtatgtcacctacctacctacgtacctgctttcttttttctgacagtgccattcagaagggatatggttattctaaggctgagggaatagttatgtaaacaaaaataaaagagtagtttgtgagtatgatttagttagggaattgtgtttggagtacaggctccttctggaagagagagatgcgattagagtgacggtagtga

SEQ ID NO: 44225 - DNA, 331 bp, Homo sapiens
gcgagagggacgcgtacaaggagaaatacgagaagttggtgagcagcggcttccgagaaaacggctcgagcagcgacaacccgtcctctcccgagtttttcataactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttaagagaagaaggct

SEQ ID NO: 44226 - DNA, 465 bp, Homo sapiens
  misc_feature 12: n = A,T,C or G
gtcgatattgtntgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgt

SEQ ID NO: 44227 - DNA, 465 bp, Homo sapiens
acatgtgatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggttt

SEQ ID NO: 44228 - DNA, 111 bp, Homo sapiens
agtctcaatctccaacacatatggcctagactacgtacataacctaaacctactccaatgctaaaactaatcgtcccaacaattatattactaccactgacatgactttcc

SEQ ID NO: 44229 - DNA, 461 bp, Homo sapiens
  misc_feature 36: n = A,T,C or G
catgaaggttttctgcaacatggagtactggcgagnacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacagaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcat

SEQ ID NO: 44230 - DNA, 487 bp, Homo sapiens
  misc_feature 455: n = A,T,C or G
atataagaagtaaggtttagaaaccacacctggcaagggtacctgacattctaagatatcaagacacttaatatgtgggctattagctgcttatttaaatgttgaccaaattgtctgatatatctgattaatcatgatttcacttcatttcggaagaaaaattatccatatcatttttaaagacgcaaatgactttggatttttgcatagagtacaatagacacttcaaacaatagattctaacattctctgaaacacttgagatgtttgagctaccatttatatgggttatttatatttagtctaagtaacacatacatgtttaattgattctgttttcatggatagattcaactaagtcttccaagcaattaattttttgttcgtcggcgtttttccttcatacgttatctagttatgcagcactggaaacagactgaagatcataaaccagntttatcagacctatgtgtaataagactcctgt

SEQ ID NO: 44231 - DNA, 463 bp, Homo sapiens
ggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcgggttgttcttt

SEQ ID NO: 44232 - DNA, 466 bp, Homo sapiens
aatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtct

SEQ ID NO: 44233 - DNA, 490 bp, Homo sapiens
  misc_feature 33, 375: n = A,T,C or G
ggatacggttcctccaccgagcccatgcgaagntttccactatggcttccagcactgtcccggtgagcgctgctggctcggctaatgaaactcccgaaataccggacaacgtaggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagcttgaagtttgattcanatgggcactttttcttccccttccctgcctagtttccttttgttccttgagtccacgcagaattccattctctggtcagcagacaggcttaagctaaagtattgcctctattctg

SEQ ID NO: 44234 - DNA, 474 bp, Homo sapiens
ctcaccctgttctctgttttgttccccacaatttctgcagagttcctgggcctgcagtcgatatcctggttactctaagtctccttttccctgggcttttacccacccaatcaaacaagtcccatctcccaatgatctgatgtcaaagttttcagatgtgatgaattcatgatgtagtattgagtgcctatcatgtgcattatgctaattaatgtagaccacagactgcaaagtggcagcctatggtatacccagcctacagatatgtttttttttaaatagtctaagtgtttaaataaattggaattagttgccatgttcaataactgaaaaacttcacatttaaaaagccagtttctgcttttctagaaaagtgggaagaactggtgatgttattgggcccacattgttgcaggcagggcagttatataccagagctcagtagagttttctcctttgataagggaatgaact

SEQ ID NO: 44235 - DNA, 388 bp, Homo sapiens
  misc_feature 25, 329, 377: n = A,T,C or G
ctttcccctggctggcagcgcggangccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcattgcccagccactttcagcccgaggctccaagangtgtggccccgccgggtccctccaagccctggaggggctgaaaatggngggaaaaggac

SEQ ID NO: 44236 - DNA, 203 bp, Homo sapiens
tgagaccatcctggctaacacagtgaaaccccgtctctgctaaaaatacaaaaaattagccaggcatagtggcagcacctgtggccccagctacttgggatgctgaggctggagaatcgcttgaacctgggaggcagaggttacagtgagccaagattgcgccacttgcactccagcctgggcgacaaagtgaaactccatct

SEQ ID NO: 44237 - DNA, 463 bp, Homo sapiens
caactgaaagggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgatagctggaagttcaatgctcagtcctaccttggctcccattaaacatttggtgctctgtggattgggttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcaagttgctctttggcaatgtcccttaaccatgatta

SEQ ID NO: 44238 - DNA, 312 bp, Homo sapiens
  misc_feature 22, 143, 152: n = A,T,C or G
attctaagatatttataatttngttcttagaggtctttgatcaattctgagttaatttttacatacagtgttaggcagattttatcactccaaaaaggtaggagtacagcttcattctgtgcaagataagttgatcatattangaatattangagcaggccacgaggcttgggagctctagtcccttattgtaatggtgaggcaccgtaaggtactgtgaggttcaattgagagataaacactgactctaaaggcctatttgaacctaaagtacctccgaactctttttctttttttttgagaccctatctc

SEQ ID NO: 44239 - DNA, 465 bp, Homo sapiens
gtactttcttggttacttactcctttttttatttttagactttttttttaacttcctgctgcttcatatcctatagtttacagatcaagaaaagcaacttatggaaacaactacagaatttacaaaaaaggtaaagtaatatgtaaaaatgtctcttttgtacagttcttgtgccttgtataactgcttttatgtgtaccagtttataagtttagacttttaaaaactacccttgtagagtctctggcttcctcatagctattatagttaaccagcacttttggggaacctggcaccaggtagatggtcgcccatgagccatgaccttgaagtaagaatcaagatttcctcatagtgtgcttttttaaactaaattacttctataatagaaaataactattttttgggccaggcacagtagctcacacctgttaatcctgcactttgggaggctgaggcaggagt

SEQ ID NO: 44240 - DNA, 388 bp, Homo sapiens
ggagagggagcctgagaaacggctaccacatccaagaaaggcacaggactcgctaagtgttcgctacgcggggctaccggatcggtcggaaatggctgaagtggagagatcgcctgagcccaggaggtcaaggctacagtgagccgtgactgcaccactgcgctccaccctgggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagctttcatcctgaaggcacggagcaccgtgcgtgacatcgacccccagaacgatctcaccttccttcgaattcgct

SEQ ID NO: 44241 - DNA, 475 bp, Homo sapiens
  misc_feature 415: n = A,T,C or G
gaggtcaggagtttgagaccagcctggccaacatagtgaaacgtcatctctactaaaaatacaaaattagcggggcatggtggcgcatgcctgtaatctcagcctcctgagtagctgggactacaggcgcccgccatcacgcccggctaatttttttgtattttttttagtagagacagggtttcaccgtgttagccaggatggtctcgatctcctgactttgtgatcctcccacgtcggcctcctaaagtcctgggattacaggcgtgagccactgcacccggcctgactacttattttttatttccttattccaagtacaagaccagaaggaaaacgaattaatgcttcctgtcattttggaaagtacttagaaactttaaatattggcagttaaactgcctgacagctcagnggaactcttgttttggaatacattgcagttaggattatatagttacatttttggaaaagt

SEQ ID NO: 44242 - DNA, 324 bp, Homo sapiens
  misc_feature 84: n = A,T,C or G
agggtacgattttatgaaggctctgagttggtggctgactctggcgtcaccatagacaccacaatgcgtggaggccgacttggngttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatataccaaaacgttttatgtgaatgtggcaat

SEQ ID NO: 44243 - DNA, 175 bp, Homo sapiens
gttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaactt

SEQ ID NO: 44244 - DNA, 283 bp, Homo sapiens
gggtgccgtggctcacgcctgtaatcctagcattttgggaggccgaggcgggcagatcacttgaggtcaggagttccagaccaacctggccaacatggtgaaaccccatctttactacaaatgcaaaaattagctgggtgtgttggtgggcacctgtaataccagctactcgggaggctgaggcaggagaatcgcttgaacctgggaggcagaggttgcagtgagccaagactttgccactgcactccagcctggctgacagagtgagtaagactccatccca

SEQ ID NO: 44245 - DNA, 145 bp, Homo sapiens
  misc_feature 12: n = A,T,C or G
ctcactcccagnactttctgattcaataggtcttacagcatgggaactttcatttctaacaagttcccaggtgatgctaattcttctggtctagtgacaacaatttgaaactactcttctagatgatgtcacaatgagaccatac

SEQ ID NO: 44246 - DNA, 465 bp, Homo sapiens
  misc_feature 4, 6, 9: n = A,T,C or G
gagnanaanaggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaaaagaagtattgcaataatttatcttcgtacaacctctacacaacaaactgccttatactttacacatcactgaacgattgatgaatgaatacacgaacatatgcatggcttggttcttgaat

SEQ ID NO: 44247 - DNA, 370 bp, Homo sapiens
ctcccattcttattgaatacaagccctgatcttccatctcctcagcaaaaaaataggagccctggccccccaactttcttcagagtaatagccttaattccttccctatctccttaccaaagtacaagtcacgtctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttat

SEQ ID NO: 44248 - DNA, 476 bp, Homo sapiens
catttatataagtaatttatataaaaataacattacagttgcaactttctgttgtttctcaactatgaccaaacagaggttacaagtaaagtagcaatcccaatactaaactgctatatgtgcattttgaatcaatcatgtgtatgtcaatgaagtttttaatgtgacagatttgcattttggttgttaatttatataatctaggttggataaatgacaatgccaatcataggggataatgttgatcctaaatgttagtgtgttgatttcataacactcaatggagaagccagtctcagagaggcatggtgctagactggaagacaagaatttcaaataattacagtaagctgatggaattcacttttatctatttttataaagcaagtgattttgtatttttaaaatttatcttcaattcttcatcaatagctacttttaatcattaaccttataaatttaattatatttcaatt

SEQ ID NO: 44249 - DNA, 482 bp, Homo sapiens
atagtatctaggaaaaaagacccaaagactaaagatgcctttgagatgaagttctgcatcatctggcagttagcttcagcaatcctcttaaatgaaacaaaacagcagccacactgcaaaccagcactgagtgcagtgtctacgtccctgcttacccaggtgtggaataagcttgctcttcctttcataatgcaatataataccaggtaaacagatttcagttacttttgcagacgacgaaggcagaattttgccttgttctttaggcctgagagttcttcctactgacattatgaagacattcctatatacagtcacaaggatgttttgctccatgacagaccgcatgtccagcagtggtcccataacgttgtaatggagcagatgtagaaacctgttggatggcgcttgatattggcattgagatcaagtaggggaaatgactgatggtcagtaatgatgctgggacattctgttttcca

SEQ ID NO: 44250 - DNA, 468 bp, Homo sapiens
agattatagtgtaatgaaaaatacctattaacctgcttctctaataatttaatatctggtttcctgataccatattaatgcaaatcctacaactataactaaatgagagaactatttagagtagataagtaagttactggttagaggaaagttttaaaacaatgtcttccaaataaggcatcatttttccttatatcttaagtaccaacagatgaatagttattgcacaaggaaaactagctaattcctcctttgatagactttcttttaagactagtagatctgctgatttctatatcaggataacctggagatcattttcaaccaatcagagacaaacttttctccatgatcaataagtatttcttgactgaaagagtgaaggctggctgggtgcccgtggtggctcacgcctgtaatcccagcactttgggaggccaaggcaggcaaatcacctaaggtcaggag

SEQ ID NO: 44251 - DNA, 120 bp, Homo sapiens
caacctggaggccatcaactacatggcagctgacggtgacttcaagatcaaatgtgtggcctttgactgaaatcagccagcccatggcccccaataaaggcagctgcctctgctcccgcg

SEQ ID NO: 44252 - DNA, 348 bp, Homo sapiens
atctaagtggagagccaaatcggaacacaatcccgtttacaattgccagaaaaagaataaaatacctaggaatgtagctaactagggaggtgtaaaatctctgcaaggacaattacaaaacgctactccaagaaatcagagatgacatacacaaatggaaaaacattccatgctcatggatagggagaatcaatattataaaaatgaccatattgcccaaagtaatttacagattcaatgctattcctatcaaactatcaatgacattcttcacagaattagaaagaaactattctaaaatttatgtagagccaaaaaagaatccaaataccccaaacaattataagt

SEQ ID NO: 44253 - DNA, 478 bp, Homo sapiens
tctgttgtatttttttcattcctgcatcccagtgaggcatctaaggttaacaatctgaaaaatgagggataatatgacccacctattaggttatttgaaagattaaatgagataatccttttaaagtatctactgtaatacatagtacatagtaaaagctcaataaatgttagaatgttagctgttagtatggttattgtatcctaatacattattgacaacagtaagaatgaaaatgaaaagttcaggctgggcatggtgtctcacgcctgtaatcccagcattttgggaggctgaggtgggtggattacctgaggtcaggaattcgagaccaggcgggccaacatggtgaaactctgtctccactaaaaatacaaaaattagacaggcatggtggcaggtgccttgtaatcccagctactcgggaggccgaggcaggagaattgcttgaacctgggaggtggaggttgcaatgagc

SEQ ID NO: 44254 - DNA, 311 bp, Homo sapiens
  misc_feature 12, 23, 96: n = A,T,C or G
acttctttcccngggaattcggnttttatggccgaggggtttattggttattggttagtttatggatacaattcatgataaatttctttaaaaatnaaaaaatagaaaaactgagatagcacatggctatatatgattgatcaccccaaaaataagcagcatgaatttataaaagcaagaccagtatgcgtgagagttcttagaaaagcctgcactcaggagaatcgcttgaaccagggagttggaggttgcagtgagccaagatcacgccacagcactgaagcctagcgacagagcgaaactccagctca

SEQ ID NO: 44255 - DNA, 160 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcg

SEQ ID NO: 44256 - DNA, 116 bp, Homo sapiens
  misc_feature 9: n = A,T,C or G
gagtccagnacaaatgttatttatatacacatccaaatttgaagagaaaatgtatttctttaggtttcaaacactgtaatagatataaagcaaaaataaaaacctgttgcaaagtt

SEQ ID NO: 44257 - DNA, 491 bp, Homo sapiens
ggtttgggggtgccttggatgcagcagccaaggtgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatccgtcatccgtgggatgatatttcatatgttcttccgga

SEQ ID NO: 44258 - DNA, 383 bp, Homo sapiens
  misc_feature 351: n = A,T,C or G
ggacatgtagaatccgatggagcactgcacaccagaatgattggccaatgagcagcttctctccctgaaacaataactgcccatttggcaaagggaaaggatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggngctattatttacctatgtacgtgtagttatgt

SEQ ID NO: 44259 - DNA, 187 bp, Homo sapiens
aattttctcattttgagacagggtctcgctctgtcacccagactggagtgcagtgtcgcgatctcgcctcactgcaacctccacctcccgggttcaagcagttctctgcctcagcctcccgagtagctgggattacaggtgcctgccaccatgcccggctaattttttgtatttttagtggccaaca

SEQ ID NO: 44260 - DNA, 463 bp, Homo sapiens
gcttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtaagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctac

SEQ ID NO: 44261 - DNA, 475 bp, Homo sapiens
  misc_feature 348, 444: n = A,T,C or G
gggctggtcgcggtggctcacgcatgtaattccagcactttgggaggccaaggtgggtggatcacttaagatcaggagaccagcctagccaacatggtgaaaccccatctctactaaaaatagaaaaatcaggccaggcatggtggctcacgcctgtaattccagcactttgggaggctgaggcgggtggattgcctcagctcaggagttcgagaccaccctgggcaacatggtaaaaccctatctctactaaaatgcaaaaaattagctaggcgtggtggcatgcgcctgtaatcccagctactcgggaggctgaggcatgagaatctcttgagcctggtaggcagnaggttgcagtgagctgagattgtgccacagcactctagcatgggctacagagtgagattctgtctcaaaacagaagacaaaaatttgctgggtgtnggtggcaaggtgccttgtagacccagctact

SEQ ID NO: 44262 - DNA, 475 bp, Homo sapiens
  misc_feature 12, 29: n = A,T,C or G
ctgatttccggnggctgagaagtccaagnatcaaggtgctgacaaattcactgtctggttccaggggagaatccagttgcttgcctttttcagcttctagaagttgcctgcattccttgacttgtgaccccatttcatcttcaaaaacagcaagggccagaccccatttcatcttcaaaaaaagcaagggccatctcagtttgtcccacgtgtaatcattgcctcactcttctgcctccctcttccacattcacagacccttgtgatcacaaagggccaacctgggtaattcaggataatttccttattttaaagtcagctgattaacaactttatttttatctgctaacctaattcccctttgtcatgtaatgtaacatattcatattttcctgggattatgatttaaacagcattaggaagccattattctgtctaccacagataccgccattttatttgaatgtttgactta

SEQ ID NO: 44263 - DNA, 476 bp, Homo sapiens
  misc_feature 146, 209, 437: n = A,T,C or G
cacctcagccccctgaccctatcatcaccatggaaaaagtgacttgagcagaggctctccctatagagaatctcctttgggtcattttgaaagctatggagggatgccctttttccaggctcagaagatgtttgttgatgtaccangaaaatacagtgatactggatgagatgacccttcggcacatggttcaggattgcactgctgtnaaaactcagttactcaaactgaaacgtctcctgcatcagacgttctcgctgtgttgcccagactggaatgcagtggcacgatctcagctcactgcaacccctgcttcctggattcaagcgattctcctgcgtcagcctcctgagtagctggaattacagcatgatggaagtggttcattgcatgatattcaactgtcattgccatccagtccagaaccagaagatggngataaagtttataagaatggaagatttattaaatgaaat

SEQ ID NO: 44264 - DNA, 467 bp, Homo sapiens
  misc_feature 6: n = A,T,C or G
ggcggncgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatat

SEQ ID NO: 44265 - DNA, 308 bp, Homo sapiens
agaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgcttggttttcctgaaaataaatgattttaaataagc

SEQ ID NO: 44266 - DNA, 266 bp, Homo sapiens
  misc_feature 24, 35, 38, 62, 68, 74, 84, 88, 106, 110, 134, 157, 176,185, 196, 221, 235, 258, 261: n = A,T,C or G
attgaaataggcgctcattctgcnatttcaccttncgncctgagcagagcctgaattacgtntttggncaattncatggtgttncacnagagtgcgctagagactnaaangaaatgtccatctggaaagattcngaagacactttgccgaggggatnaagctgagatgatgcttgnatggaaagnttgatattttnatcagtcacatggcttttgaaaaangatgtatatatttnaaattaactattttcaataaaanatntcact

SEQ ID NO: 44267 - DNA, 345 bp, Homo sapiens
gctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcccacaggaggaaaagcaaggcttacagaaggatgttccttcaggaggaagcagcactaaaagcactctgagtcaagatgagtgggaaaccatctcaataaacacattttgggga

SEQ ID NO: 44268 - DNA, 353 bp, Homo sapiens
agattaaagcagataatgaaatcatggggccaccctggctctatccaagacaatggaacagagatggaatttgatggtagtgtaaacacaatgtggctagtatctcccctcccaggaatctcacttctcttagagtgatatcttctagccaccctgaagttcaggcctgattcattccatggcacagattgaagacataattaccatgacaggccagggggagaaaatgtgattgagatattggctaggtggatagcagctcctgggacacctgagtgattacctacttagttaaaaagtatatgacccatgtcaatttctcacatcactctgcagtcatatctccaggctac

SEQ ID NO: 44269 - DNA, 317 bp, Homo sapiens
  misc_feature 9: n = A,T,C or G
attgaaagnaactactaaaggatgtgctgtaagtaaagaggaaactgagcccaggaaggagagggagttctagaagtaataataatgaagaaattgataaacagctaggtaaatctttgaatggatgtaggatgttttaaaaacagtaataataagacaacaatcaataacacagaagatgggagggtaataattacagtaaaaagcactttaaggtgctaatattgtttaggaattagaaaaaaatattgattaattttagattttctgtttttctttttttgagacagcctgggcgactgagcgagactccatct

SEQ ID NO: 44270 - DNA, 277 bp, Homo sapiens
ggtgaattgataagtaaaggcagaaaagattatatgtcatacctccattggggaataagcataaccctgaggttcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 44271 - DNA, 455 bp, Homo sapiens
  misc_feature 434, 451: n = A,T,C or G
ctagtctacttgaaggtagtggagtcataaggagagacaaaaacaggtttgtgccataaagtattttttcaaagacaccaaggatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagnatttttttaaaataatnttat

SEQ ID NO: 44272 - DNA, 298 bp, Homo sapiens
cggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcact

SEQ ID NO: 44273 - DNA, 388 bp, Homo sapiens
  misc_feature 2, 33: n = A,T,C or G
gnaccccacaaggaagccaaagttttcaaactnctgcatactttgacaaggaaaatctatatttgtcttccgatcaacatttatgacctaagtcaggtaatatacctggtttacttctttagcatttttgtgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctg

SEQ ID NO: 44274 - DNA, 134 bp, Homo sapiens
  misc_feature 7: n = A,T,C or G
agggganaagcgggctgggggtagcctggatgtgggccaagtccactgtcctccttggcggcaaaagcccattgaagaagaaccagcccagcctgccccctatcttgtcctggaatatttttggggttggaact

SEQ ID NO: 44275 - DNA, 324 bp, Homo sapiens
  misc_feature 6, 324: n = A,T,C or G
atttantaacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaagtgaan

SEQ ID NO: 44276 - DNA, 129 bp, Homo sapiens
gtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 44277 - DNA, 476 bp, Homo sapiens
gatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaaggagttgggatttctcagcactgctaatgaagatcccctcttatagtccaataagcttatcaggacttccaga

SEQ ID NO: 44278 - DNA, 349 bp, Homo sapiens
  misc_feature 252, 341, 346, 348: n = A,T,C or G
tgtggtcggttcacacctgtaatcccagcactttgggaggccgaggcaggcagattgcctgagcccaggaaaccaggaccaccctgggtaacatagtgaaaatacgtttttccaaaaaatatgaacattagccaggcatcgtagcatgctccctgtagtctcagctacttgggaggctgaggcgggagagtcacttgagccttggaaggcagaggctgcagtgagccaagacccacaccactgcactgcagnctggaccacagagggagaatcctgtctcaaaaaaaaaatccctaacggggggttccagggaaaaatttttttccccaatttgggccctnttttntnt

SEQ ID NO: 44279 - DNA, 468 bp, Homo sapiens
gttttcaggaacccctgagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagaattttgacctggcttta

SEQ ID NO: 44280 - DNA, 391 bp, Homo sapiens
gggggtcaaaatcatgtcgtgtgactaaatcacgatcccaaaatcttccaacaaactagagcagtgaacagggattagcaaaatgagatttaacaggaatacatgtaaaggcctgtatttggcttgcaaaacccactaactaccctagtactggatgggggaagccattgctgagacagcacacatgcaaaagacttcagactttcagttgactccatatttaccaagagaatgtatccaaccttgggatacattaagaaatatgtagcaccctgccaggcgtggtggcttacgcctgtagtcccaacacttggggaggccgaggcaggtagatcacttgaggtcaggagtttgagaccagcctgaccaacatggtgaaaccccatctcta

SEQ ID NO: 44281 - DNA, 354 bp, Homo sapiens
  misc_feature 293, 303, 312, 349: n = A,T,C or G
ggcatggtatcagaaaagctgagtaaggatagagactggaggttaatacccaaaaaacagtaaaaagtagcttcactcctccactctactttccctctttccagtgttaacagaagagtgttgggaaactgagcttctatacgttcctgggagtagtgacatgttacaccaccttccgagactctcataatgtaatacctaaaatgtccaggttttattttgaatcactcatcacaccaagaaccaggaagatcccaaatgaaatggaaaaaaaaaaagataatcagtagatntcaacagctngatgacagnaggggtcaaaggttttaaagcagctgtcacagaaaangcttc

SEQ ID NO: 44282 - DNA, 242 bp, Homo sapiens
  misc_feature 12, 13, 52, 57, 60, 107, 152: n = A,T,C or G
catttagctagnnggatatgactaggcatattttaaaattctagatctgtgntttcntangtgtatatccttggcaggctttgtaatgctttctaatcctgcttgtnatataagttataaagtcaagtataaagctaaataaaatagtatgngcgggacatctagtgcagtgcctggctcattggacaaccgcaaagagtagtaagtgctgccgctattcacaattagaaaaggaaatcagg

SEQ ID NO: 44283 - DNA, 474 bp, Homo sapiens
  misc_feature 168: n = A,T,C or G
gctttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattangacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagtattaaagaagcaaaggactcagaattcatgattgaagaaatgcaggcagacctgttatcctaaactagggtttttaatgaccacaacaagcaagcatgcagcttactgcttgaaagggtcttgcctca

SEQ ID NO: 44284 - DNA, 213 bp, Homo sapiens
  misc_feature 34, 35, 37, 87, 118, 151, 152, 212: n = A,T,C or G
ctgaagcaacacgatttctgacattgatgatgcnntnagaaaactgtaaaattcgagccatataaataaaacctgtactgttctagntgttttaatctgtctttttacattggctttngttttctaaatgttctccaagctattgtatgtnnggattgcagaagaatttgtaagatgaatacttttttttaatgtgcattattaaaaatgtng

SEQ ID NO: 44285 - DNA, 277 bp, Homo sapiens
  misc_feature 3, 7, 8, 20, 50, 143, 145: n = A,T,C or G
ggngttnnctcactcctgtnatcctagcactttgggaggccaaggcaggngaatcatgaggtcacggagatcgagaccatcctggctaacatggtgaaaccccgtctccgctaaaaaatacaaaaaaattagccaagcgtggngnagggcgcctgtattcccagctactcgggaggttgaggccagagaatggcgtgaacctgggaggcagagcttgcagggagctgagatcgcgccactgcgttccagcctaggcaacagagcgagactctgtcgc

SEQ ID NO: 44286 - DNA, 359 bp, Homo sapiens
atgttacacatttatcaaaatccatatgtgtactttatacatttgtcaaaatccataaaagttacaaaagtacaaaaaaagtacaatattcataaaaagacaacttgatgctcaaaagtttcggattttggatgtttggatttgagatgctcaacccatagtaaaattcgctctttttcagaatacagttgagttttgccaaatttgacagttcacgcaagccccaccacaatcaagatatgggccgggaatggtgactcatgcctataatcccagcaccttgggaggacaacgtgggaggattgcttgagcccaggagttcaagacaagcctaagcaacataatgggacttcgtctcg

SEQ ID NO: 44287 - DNA, 219 bp, Homo sapiens
  misc_feature 16, 198, 212: n = A,T,C or G
tatggccgggaagtcncaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatatatgcacagntatctaagttaatntaaaggt

SEQ ID NO: 44288 - DNA, 207 bp, Homo sapiens
gtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgctttt

SEQ ID NO: 44289 - DNA, 213 bp, Homo sapiens
gtgagcggggcatctgttggactttccacctggtcatatactctgcagctgttagaatgtgcaagcacttggggacagcatgagcttgctgttgtacacagggtatttctagaagcagaaatagactgggaagatgcacaaccaaggggttacatggcatcgcccatgctcctcacctgtattttgtaatcagaaataaattgcttttaaaca

SEQ ID NO: 44290 - DNA, 482 bp, Homo sapiens
  misc_feature 33, 476: n = A,T,C or G
gatcttttgtctttccgtggagctgtcgccatnaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggcttgctgctaaggcaccttacaaaggcagcaccttaagcaaaagattgtgaagcctgtgaaagnttcagc

SEQ ID NO: 44291 - DNA, 249 bp, Homo sapiens
  misc_feature 192: n = A,T,C or G
attaaaagttttaataataagagtatgtaaatatactttctttctggaatagcctaagtgtagttgtatctacaagaaagagagtaaaaaatctcatccttttcaaagatgcacatttattattgtcatcaaaaccattaagtgttttttggcatgagatactactatattagttgctatgcggagcaattnggaccgaaatcccacatttctttaggaattatagcctcattcctgcagaggctgctg

SEQ ID NO: 44292 - DNA, 309 bp, Homo sapiens
  misc_feature 6, 245: n = A,T,C or G
gacgcntttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctnctgtgcctgatgccaggacagctgtgctctcagatgtaaatagagcaacctatataaacctgga

SEQ ID NO: 44293 - DNA, 376 bp, Homo sapiens
  misc_feature 31, 345: n = A,T,C or G
gtgggttgaaagaaaggttagcatgattcanttagaacatggtttgcttttttatattaaacaaactttcttatttcattttgttctatttgttactacttgaagatcaggttgagtagaaagatagtatgtttttactaataatagatataatgtgattgagacctgacaggtgacattctactgacagtatccagagattattggaatttgggtttgggagctcatggtaattgctggatctgcagattggagacttggagatataattttaaagtgctagctgtcacctgcaagtgagagcattttgagtgagaatttggggaacacctaaatttaataagntggcacatctttcttagtgcttctctcctta

SEQ ID NO: 44294 - DNA, 480 bp, Homo sapiens
  misc_feature 361: n = A,T,C or G
gaaatgttcttctacaaatgaaaaagagtttaaaaacgttacaagggaagctatgccttctgaagtctatccttagttgaaacagaaaataaacacaaaggtacaagatccttaaattattttgaaccacagaggttgaaattgttttgtgatcttcagcagaaataaaatctgtacatgattttcttttatgccttttagtttacagtctttattagcaatttcagtgaatttgtagagcatagtaataggtatttactgtccacttatatatatcagcatctggtcatgcacgaaccattaattctatatttctatttcaataattctaatatattatttctataaatgtaatatctgnatgtggcaaagagcctttcttctcaagatcctgaaaagctgggtacctgccctttgagtgccacagtcctgaactgcttgttcttgacatcttgcatattacttcagagttccccactg

SEQ ID NO: 44295 - DNA, 462 bp, Homo sapiens
  misc_feature 447: n = A,T,C or G
acagacttcctactataacctgctgggggtactatggtgtttccttattggcttttctaaatattgtctaaacctttgcaaatattccttttgttaaactctccttaattatcctgtttgagtattatctgttttctgctataatatatcaactgaaaatttgtggttctcatgactcatgaaaattagggggtctactagacattacaatatgttgatatttaagatttttcaaaagtagaattttgaacataattattaacaataatttttcttacctgttcatagactttgaaccttccaaaggatagtagaaaagagcaattatagtgagaacagtttccatggtgtttgtaagggttctggtacagcaataccatgtgaaccaggagcacaactggcaaaaaaactaagaaaaagtacagagcaaacatatatgaaattggnaatggaaaaccttag

SEQ ID NO: 44296 - DNA, 441 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 44297 - DNA, 475 bp, Homo sapiens
  misc_feature 401, 454: n = A,T,C or G
tgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagtagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaanggttttttttgtacgcaattctcgattctttgaagagatgacaacaaattttngggtttctactggtatgtgag

SEQ ID NO: 44298 - DNA, 488 bp, Homo sapiens
  misc_feature 6, 472: n = A,T,C or G
attcantcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctggggttttttcttctttctttaaacatagaggnaccaccacaagggatg

SEQ ID NO: 44299 - DNA, 207 bp, Homo sapiens
caatgagttcaattcacttgctgccacaatgctttcaggcctaggctctttgcagacagagagcagcatcagggaatgattattacctgtgcccagcagggtttgttcaactgctaatggtcaaggtagattcaagccctctatcattcccagagacatacaaaatcaaatactgacttaaagagaaatataaatgaaataagttct

SEQ ID NO: 44300 - DNA, 226 bp, Homo sapiens
  misc_feature 32: n = A,T,C or G
attttcttatgatgtaatttatgaaaaagatntctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattcga

SEQ ID NO: 44301 - DNA, 303 bp, Homo sapiens
gtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaatt

SEQ ID NO: 44302 - DNA, 466 bp, Homo sapiens
  misc_feature 276: n = A,T,C or G
ggcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggngcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgaaaacggctccaggtacccccaactgtgcataccgggaccagccccgaag

SEQ ID NO: 44303 - DNA, 441 bp, Homo sapiens
aaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctg

SEQ ID NO: 44304 - DNA, 465 bp, Homo sapiens
  misc_feature 7: n = A,T,C or G
gaaaagncgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgcggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcatttt

SEQ ID NO: 44305 - DNA, 148 bp, Homo sapiens
  misc_feature 6, 32, 33, 34: n = A,T,C or G
ggccgnccgcggtggcgcgtgcctgtagtccnnnctgcttgggaggctgagacaggagaatcacttgaacctgggaggcagaggttgcagtgagccgagattgcaccactgcactccagcctgggcgacagattgagactctgtcccg

SEQ ID NO: 44306 - DNA, 405 bp, Homo sapiens
  misc_feature 17, 43, 72: n = A,T,C or G
tatggccgggtattatnaatttatgtaaacctggaaattctgngatccagtctctaataggagtactttgcntaccaaatatggaaataagggtaggtaaaagttattaggattgtttcattcctggacctttaacagtgggaattaattataaaaaataaattatttcaggtgatgtgttttcctcattagttgttaatctagaccatatttttaaaatacagaagtaaatatttactacttagttaaaccctaaatataataggaatcatttaaaatattgctgttgtctgggcacggtggctcatgcgtgtaatcccagaactttgggaggccgaagtgggtggatcacgaggtcaggagttcaagaccagcctgaccaacatggtgaaaccccatctctac

SEQ ID NO: 44307 - DNA, 475 bp, Homo sapiens
  misc_feature 33: n = A,T,C or G
tgcaatgataggaagaaataaaaatatgcacanaaaaaatcagtaagccgtgtaaacggatctctcaaaagaaaaagatggaaaagaagaagtaatcctttggaggcatcagttcaatctcctaacgctaattcataatatttatgatttgaatttctgttttgcttatgagataatactaatttttaaatttttggttgtcttggagttccatcaagttttatactggtgacatcgagtgctaaaagcttatccattctaaaaagactgctggatacagccacaggccaaaactgctagttttaacatccttcctctatttcttacttgtccgtagaagagaagcaattaattgaggaggcaatagacgcttaatagattttatctgtctttgtcacatagctaataagcattaaagccagtacgtctttaatccaagtatgggttatcccaaagtccatgctctttccaccac

SEQ ID NO: 44308 - DNA, 473 bp, Homo sapiens
  misc_feature 44: n = A,T,C or G
tatggccgggcaaggtcttcctccttcccttacggaattacatnttgatggcaacaaaatcagcagagttgatgcagctagcctgaaaggactgaataatttggctaagttgggattgagtttcaacagcatctctgctgttgacaatggctctctggccaacacgcctcatctgaggggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacct

SEQ ID NO: 44309 - DNA, 462 bp, Homo sapiens
ggaaactggggaaacatgcataagtgccaatcctttgaatgttccacggaaacactggtggacagattctagtgcggagaagaaacacgtttggtttggagagtccatggatggtggtcttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattg

SEQ ID NO: 44310 - DNA, 173 bp, Homo sapiens
  misc_feature 6, 26, 124: n = A,T,C or G
gggaanaaaggcagcagctaccaagnaaaccagcccctgaaaagaagcctgcagagaagaaacctactacagaggagaagaagcctgctgcataaactcttaaatttgattattccataaaggncaaatcattttggacagcttcttttgaataaagacctgattatacaggc

SEQ ID NO: 44311 - DNA, 464 bp, Homo sapiens
  misc_feature 7: n = A,T,C or G
caagcantacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatactttgtaatctactgtccagctgaaagcactcatgttacgaggaagaaactacaagtgatgttcaaatcta

SEQ ID NO: 44312 - DNA, 475 bp, Homo sapiens
  misc_feature 58: n = A,T,C or G
atatttttataatactgttagctcagttattggatgagtgaaagataatcatgttggntttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatgggtaaaagattttttttttaatcatgaagagaaaaattagtagcattttctttctctccccattatttattgggttttcctcactaatcttttttttttaggccaaaagccaaaaatatt

SEQ ID NO: 44313 - DNA, 128 bp, Homo sapiens
ggtgatcattgttgttttcatttgtgcttccctgtgtgtcctaagtttttggcatttagtgtgtgtgatttttgttaattggaaaaaacataaatatgttttgaaaaataataaaatttaaaatcgcg

SEQ ID NO: 44314 - DNA, 497 bp, Homo sapiens
  misc_feature 1, 12, 31, 58, 226: n = A,T,C or G
naaactctaggnctaacgtaactgtagggtntgcccacatgttgaagtattgccaagnagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagnaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagca

SEQ ID NO: 44315 - DNA, 179 bp, Homo sapiens
attgatgataactttgaatgtaaatggattaaattctcccacttaaaagatatagattgactgaatggattaaaaaccaccatcacgactcgactgtatgctgcctacaagaaacctcacctgtaaagacaggccaaaagtgaaggtatggagaaagatattgcatacaaatggaagcc

SEQ ID NO: 44316 - DNA, 471 bp, Homo sapiens
  misc_feature 32: n = A,T,C or G
ctccaccggcgctccacctccatctcttatancaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacatacagggaatatgcagaaagaggttatgagcgtcacagagtaagtcgagaaaaagaagaacgacatagagaaagacgacacagggagaaagaggaaaccagacataagtcttctcgaagtaatagtagacgtcgccatg

SEQ ID NO: 44317 - DNA, 471 bp, Homo sapiens
  misc_feature 332, 455: n = A,T,C or G
gctgactttaatatatgaaacctaatcctatccccttttttaacaaaaagaaactagtacatttgtgaaaattgtgttgtgttgtccattgttgctctagttctgacccagaggtagctctggagtgattttagacctactcactcagttgtgtgtaggttttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagntaactaattttttcttacctaatcttttgggagttttgcttgttgatataacctttttagttaacctgaaagattccaaaaattgttcttaagtgcttgagactggaaccaaaattaaattgnacttcataaaatcctc

SEQ ID NO: 44318 - DNA, 464 bp, Homo sapiens
  misc_feature 14: n = A,T,C or G
gaggagcatcctgnatcttttgactggagctcttttaagccaatgggatttgaagtatcatttctgaagtttcttgaggagtctgcagtgaagcagaagaaagatactgacaaagaccatccgaatactggaaacaaaaaaggatcccattcaaattcaagaaaaaatattgataagactgctgtgacctagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagt

SEQ ID NO: 44319 - DNA, 488 bp, Homo sapiens
  misc_feature 4, 7, 30: n = A,T,C or G
gatncancatgcaacctggtcttttttgtnttttttggttggtttggtttggcttggtttggctcaaagaccaactggcagagatagcagagaaaatgctgtacattttaacctaatttttgaaaattattcagtaaataagtctgttgactgggccaagttgtaaacattttctaagctactccagtacactgctgttaatacaattaaaaatgcaaagtcaaagtgacttccaattcaaaacgatatttgcctcacagctccaacgtagcttctccctttgatatgatgaaaatattgataagggcccataaaagggtaaactttccatcctattgcttggaaggcatcagttcagcacacgagcagcccctcaggaggaagagagagtatctgtggagcagaggtaaacttgtgagcactttgttagaaacaaggatcgctaacacggtgaaaccccgtgtctactgaaaatacaaaaaaattag

SEQ ID NO: 44320 - DNA, 107 bp, Homo sapiens; identical to SEQ ID NO: 31600

SEQ ID NO: 44321 - DNA, 408 bp, Homo sapiens
  misc_feature 6: n = A,T,C or G
caaagnaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggt

SEQ ID NO: 44322 - DNA, 469 bp, Homo sapiens
  misc_feature 18, 56: n = A,T,C or G
tagcacatcgaatcattngtagtgctaataccagcaaataagaatatccattcagnggacttcatatatacaggttgagcatcactaatccaaaaatccaaaatctaaaatgctccaaaacctggaactttttgagtgcagacatgatgcaacaagtggaaaattccatgcataagtacttattacaaactttgttttgagcacaaaattatttaaaatgttgcataaaattaccttcaggctatttgtataaggtatatgtgaaacataaataaattatgtgtttacacttgagacccatccccaagatatctccttatgtacttgcaaattttccaaaatccagaaaaaaaatttctgaaacccaaaatacttctggtcccaagcatttcagacactcaaccaacattcatgatgagtctaagtatgcacaattgtaatgatctccctcaaacatccctagctcttt

SEQ ID NO: 44323 - DNA, 467 bp, Homo sapiens
  misc_feature 360, 361, 455: n = A,T,C or G
agcctggggtccacttgtactaccatgtctttttctatcatgtttttctgtacctatcactttctttctcatcttttttcatgcaaaataatttcttttcttttttttcttttctctaactataaaataatatacccatgggggggaaaaatccagcaatgttatttcaaaataaattctgtaagctttaaattttccatttttcacttggtacaggaaaagaaaacccccccattcatcacccagagttaaccattattaacagtttagtgtatgtgcccttctatgctttttatgtgtacatatacacatattttcccaaaagtgatatcataacatacttgctagtctgtaatttgnnggggttttatttatattatgggcattgggctatgttaacatatataaatctacctcatctttttaaatagctgcaaaatattccattttatagncatactataatt

SEQ ID NO: 44324 - DNA, 363 bp, Homo sapiens
  misc_feature 6, 7, 32, 329: n = A,T,C or G
cagagnngctgggactacaggcgcccgccacnacgcccggctaattttttttgtattttttagtagagacggggtttcaccatgttggccaggatggtctcgatctcctgagctcgtgatccgcccgcctcagcctcccaaagtgctaggattacaggcataagccagcgcgcccggcgtcttttttctaatatttcaaaaccctagacaatatgccgaatgttaaagtgtcttgaaggttcacttgcaactgtggaagtggaaatacagtcctctaagaataaagtttcagtgttcttgttacccgtgaaatcttttctaccggaggngattactaatatgccttgacagatggtcttctca

SEQ ID NO: 44325 - DNA, 197 bp, Homo sapiens
  misc_feature 5, 167, 196: n = A,T,C or G
aggantacaatgaaactctcattgtatcacactttactattcctctctcactttcccccctgggttcccaagtattgttttccctattgcaacatttaaaatagctatgttcctgaggaagacgagaattttaggaaagacttcaatagagcttttctagtgctacnttccttccaggtaagtaaaaatttactanc

SEQ ID NO: 44326 - DNA, 430 bp, Homo sapiens
gattcctgaagctgacagcattcgggccgagtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcctgtactacactgaattcacccccactgaaaaagatgagtatgcctgccgtgtgaaccatgtgactttgtcacagcccaagatagttaagtgggatcgagacatgtaagcagcatcatggaggtttgaagatgccgatttggattg

SEQ ID NO: 44327 - DNA, 184 bp, Homo sapiens
  misc_feature 3, 4, 18, 36, 49, 57, 64, 103, 129, 142, 160: n = A,T,C or G
gannacccgctcgtgtgnactgttgagagcaatttnggtcaccagcagntgtactgnaagccanccgcgaaaattcggccagggatctcgctcttgtcgagtntgttcaaaccggcacggtctgatccngaaatatggcctnaatatgctgccgccagtngtttccgtgcagtacgcgaaggat

SEQ ID NO: 44328 - DNA, 469 bp, Homo sapiens
caatccttcagccaatatttattgagtactactgagtggtaggtcagtttttggccctggatttacaaccacgggaataaaaacagagaagatgcctaccttcatggaatttacagtcttattttgttttatagaaatcatgtgtcctagtaatcaaatggggaaaaacagatttgtcttgaaagcagacaaagagaaatggaaaaatcaattacccctgtattactgtgtggagaaatgaaggcattcgtttggtttggcaggtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccg

SEQ ID NO: 44329 - DNA, 478 bp, Homo sapiens
  misc_feature 35: n = A,T,C or G
aatgaccggcatacattttgttaggtgattttgtnattgtgcagaatcataaagtatacttacacaaacctgggtggcatagcctgctacacacctaggctatatggcagtggcttctggactaaaacctgtatagcgtgttacttgtcctgaatattgtaggcagctataacacagtggtatttgtgtatctaaacagaaaaggtacagtaaaaatacggtattacaattttacaggagcactgccatatatacagttcattgttgaccagagtgtatgactgtatatacagtttaccctagatgcatttcagtgagaatctcaaaacatatgctcaatccctggcaatgcattgcctttatttcatgtatatcaagcataacacttgtgttcctgacttgaagttcaaactgagggtgaagattgggtctagcccttctgttaagaagtcttgactgtatcttcatcaatttgatt

SEQ ID NO: 44330 - DNA, 353 bp, Homo sapiens
  misc_feature 2: n = A,T,C or G
gntcccgcgactggacaagctgaggaagtaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctggtagggggccttccagcatgtgggcaaagccttcaatcagggcaagatcttcaagtgaacatctcttgccatcacctagctgcctgcacctgcccttcagggagatgggggtcattaaaggaaactgaac

SEQ ID NO: 44331 - DNA, 224 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatga

SEQ ID NO: 44332 - DNA, 347 bp, Homo sapiens
  misc_feature 6, 33: n = A,T,C or G
ggcagnagcgagtatgacgaagggaacgtcatngtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttct

SEQ ID NO: 44333 - DNA, 384 bp, Homo sapiens
  misc_feature 42, 331, 357: n = A,T,C or G
tatggccgggggaaacctacttcatcaaggtgcacgtcggcnacgaggacttcgtacacctgcgagtgtttcaatctctccctcatgaaaacaagcccttgaccttatctaactaccagaccgacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtgggaaggggcaggattctgcagctgcttttgattttctcttcctaaatttcattgngttgatttctttccttcccaataggngatcttaattactttcagaatattttc

SEQ ID NO: 44334 - DNA, 473 bp, Homo sapiens
  misc_feature 17: n = A,T,C or G
tatggccggggacagcncaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttctggtcagaaattacctttttgacacaagcctactgaatgc

SEQ ID NO: 44335 - DNA, 149 bp, Homo sapiens
  misc_feature 2, 6: n = A,T,C or G
antctnaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaacc

SEQ ID NO: 44336 - DNA, 173 bp, Homo sapiens
  misc_feature 7, 51, 69, 128, 173: n = A,T,C or G
agaaagnaacttacatgttcccaaatcaatggtgaggtgaatgtgtgaganaaactaacttgatagggnctaccaatacaaaatgtattacgaatgcccctgttcatgtttttgttttaaaacgtgtnaatgaagatctttatatttcaataaatgatatataatttaaagtn

SEQ ID NO: 44337 - DNA, 161 bp, Homo sapiens
  misc_feature 2, 32, 139, 160, 161: n = A,T,C or G
cnactcttagcggtggatcactcggctcgtgngtcgatgaagaacgcagctagctgcgagaattaatgtgaattgcaggacacattgatcatcgacacttcgaacgcacttgcggccccgggttcctcccggggctacncctgtctgagcgtcgcttgcnn

SEQ ID NO: 44338 - DNA, 457 bp, Homo sapiens
  misc_feature 3, 32: n = A,T,C or G
aangtccggcatggacaagatctatgaaggcntagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaag

SEQ ID NO: 44339 - DNA, 217 bp, Homo sapiens
  misc_feature 17: n = A,T,C or G
tatggccgggatggaanctttcgtgtgttcgtgccttcacttctcaactgcaaaatatgggagattaaactatattgtttttaagacctttaaaattataacattgtattctatttctttcctaattactacaaacaaataacttatcaggtaagtatctatcaaataagttttgaacatctacagtatgatatgtacggagctagtcactgaggtt

SEQ ID NO: 44340 - DNA, 133 bp, Homo sapiens
aatattttctattatgaatgttgattttcctaccaaagaagatggagagtctaaaatttggatatgattcttatgtttttttaatagaaaaccttcttcaagtttattttcctaaataaacatcataattgtg

SEQ ID NO: 44341 - DNA, 183 bp, Homo sapiens
  misc_feature 6, 14, 43, 44, 45, 64, 69, 100, 105: n = A,T,C or G
gatggnccgggggnacccttttttgcagtgctcaggacgggcnnntttggagccggccccaggnagcgngtgtcggtctgcctagtcctggagaactagncctcnactcacgtgcaaggatgatgctgaaaggaataacaaggcttatctctaggatccataagttggaccctgggcgttttt

SEQ ID NO: 44342 - DNA, 471 bp, Homo sapiens
  misc_feature 27, 34, 35: n = A,T,C or G
atatttctaaacaggaacctgtacagnaagtgcnntggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacat

SEQ ID NO: 44343 - DNA, 474 bp, Homo sapiens
  misc_feature 7, 12, 32, 33, 192, 211, 216: n = A,T,C or G
atacacntagtncttaaaaaagatgctgtgtnnttttagaggctcacagctctgcccccgggtacctatgcccatttgtaaggcacagttatctgcatcagacaccagacataccatgtggcttctctgcctaaatcatacttctctgagtcctcagagtttccccccagacccccactttttttttaaggngggtatgttctaactgggngtggnggctcatacacctgtaatcctagcactttgtaggctcaagtgatccttctacctcggcctcccaaagcacaaataacatttaagtaaccaaatgaatgatttgaaagagtaaagttggtagaaagaccataaaatagggcacatctagagaatgacatgagagtggggcattgggtaggaggtcaaggaaaggcctctgtgataaagtaataaattgagatgtgcaaataacaaatgacaaaaagccactcatgcaag

SEQ ID NO: 44344 - DNA, 487 bp, Homo sapiens
  misc_feature 6: n = A,T,C or G
tactcntacatttcatattttcaaaatttttcatgtccacttagaggcatttttttcccctaagctttggctttctgcctttatcattgctattttaagatttttacatgaaaaatgggatttgtttcttaatcctttaaaccaaattgtgttgtgaaaaagttgtgtttatgttatttattttaatattctttttttagaatcctgcaattatcctcagcatggaaagtttggccctaaaaccgcttctgagaaatcagaatgtggcctgagtctgggcggacccctcacaccttgcctgccttggacttcttatgaaacacaattgaatagataacctaaggcaaggggataaggtggccctggaacttcctcaaaggaatagggacctcagcgcagataagtagattcaaccactcagtgcagggaggtgcagtctcacgtttaacctctcagtttcattgtcatatcagcccaggggcccatc

SEQ ID NO: 44345 - DNA, 377 bp, Homo sapiens
  misc_feature 3: n = A,T,C or G
tanggccgggggcccccggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcattttttg

SEQ ID NO: 44346 - DNA, 219 bp, Homo sapiens
aaggccccagtagtattgagaccatcctagccttatgctgaaaccccatctctactaagaatacaaaaattagccgggcttggtggtgcacgcctgtagtcccagctactcaggagtctgaggcaggagaattgcttgaacctgggaggcagaggttgcaagtgagctgagatcgccccactgcactccagcctgacgacaaagcaagactctgtcttt

SEQ ID NO: 44347 - DNA, 377 bp, Homo sapiens
  misc_feature 6, 7, 31: n = A,T,C or G
aatctnnggcaagtcactgtaatttcggtcntttgtgaatctgagctacctcatagggctgtatgaggatgaaatgtagcaatatatgtgaactcatgtgggcctgttccttaatcagtgttcaaaaatgagctgttcttaaaaggaaattcttggtatgtttgaaaataaggaatttcttgcagttattcattttcccgtacagtgtagggtgccgagtaaatccaaggcagtagaatgaatatagctgtttctgtgtgagcaggacggaatgtggtagaggaaggagtactgacatttattgagtgcctgctgtatgtcaggtgtcatttaggtattttgcatacgttaggttattaaatgctcaccccccccgc

SEQ ID NO: 44348 - DNA, 489 bp, Homo sapiens
  misc_feature 3, 16, 43, 475: n = A,T,C or G
tanggccgggaattgnccgatagtttattagggactcttgttntttattttctaaatattttgtgattttttttcacagataattctgtctgttattgatctctgattttattcccttgtggtcaaaacatatattttgtgtaacttaagtcctttaataatttttgagacttgttttatatcttagaatatggtatatcttggtaaatcattccacgtgcccttgaaaacaatgtgtattctgttattttgaatagtgtgtgctaaaaatattaatgaggtcaagtaggtctatactgttattcaagtctaccatgaccttactgattttagtcctacttgtcctatcagttatttagagaatattaaaaccaggccgggcacagtggctcatgcctgaaatcccagcactttgggaggctgaggtgggtggatcacaaagtcaggagatcgagaccgtcctggctaacagggngagaccctgtctct

SEQ ID NO: 44349 - DNA, 154 bp, Homo sapiens
caactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtg

SEQ ID NO: 44350 - DNA, 223 bp, Homo sapiens
  misc_feature 124: n = A,T,C or G
gaggcattgaggcagccagcgcaggggcttctgctgagggggcaggcggagcttgaggaaaccgcagataagtttttttctctttgaaagatagagattaatacaactacttaaaaaatatagncaataggttactaagatattgcttagcgttaagtttttaacgtaattttaatagcttaagattttaagagaaaatatgaagacttagaagagtagcatg

SEQ ID NO: 44351 - DNA, 462 bp, Homo sapiens
  misc_feature 7: n = A,T,C or G
aagtacncgtggtagaatttcacagcaataattttagaagattgacgccagatcataacaagaacacaaaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcgaatggacggattggacaggttggaaaattcaaaaatggaacactgattctgagcccagttg

SEQ ID NO: 44352 - DNA, 381 bp, Homo sapiens
  misc_feature 57: n = A,T,C or G
ggaacccaggtcacctttcaaggacccagattagggttttggcctaggtaacggggnagagatgtggttcgaggttctccccggactctccgtcatgggcgtgtgcttgttgattccaggactggctactgcgtacatccacaggttcactaacgggggcaaggaaaaaagggttgctcattttgggtatcattggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtatttatgtagcatgcaatgtgttatgtagtgctt

SEQ ID NO: 44353 - DNA, 250 bp, Homo sapiens
  misc_feature 3, 6, 217, 233, 237: n = A,T,C or G
ggncanccgctgctggtattagctgagtgttttgggcaaagtggttcatctcttcattcctctataaagtggagcttataggacggttatgaggatgaaatatgtaaatacatgtaaagtgcttaccctgtgcctggcgtgcatatatattgcatatgtatgtacacacacacacacacacacacacacacacacacactcattcaacactagtttntatataaaacagatgngctngaaactgcagaag

SEQ ID NO: 44354 - DNA, 475 bp, Homo sapiens
  misc_feature 151, 152: n = A,T,C or G
gtgtacaatccatagacatctgacctcggcacttagcatcatcacagcaaaccaactgtagcctttctctctttccctgtagaaacctctgcgccatgagagccaagtggaggaagaagcgaatgcgcaggctgaagcgcaaaagaagaannatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 44355 - DNA, 461 bp, Homo sapiens
gtcccccgtggccattttcgttggtggtgttcagttgtggcggttgctggtcagcaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatattttattgacttgtagtaactgccaccaataaagcagtctttaccatt

SEQ ID NO: 44356 - DNA, 463 bp, Homo sapiens
  misc_feature 30, 32, 33, 442: n = A,T,C or G
ggaaccccaccgcgctgcgcagttttgttntnntccagctgttcgaaggtgatccaccacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggngggcacaactgtgtgctctgc

SEQ ID NO: 44357 - DNA, 463 bp, Homo sapiens
  misc_feature 6, 32: n = A,T,C or G
aacctncagtagaccataaaagctcttatgcnatctgacaaaatcaaagaaaaaaagagacaaatctacgtcagaattagatatttagtatctcttttctagttattattattataccaataggaatatataggaggtctgagcaacaatatcaacttcctaaaactaattaatgtttcataaaacactaaactgaattgaaaaatacttgtttacttaaagtgcacatggaacattaacctacaaagatattacttatactaggccataaaagcatctccataaatttgaaaatacagaaacaaatatgaggacaaaaaaatcatatagtctgacgtctaaccacactaaaatcaaattagaaatcattaacaatagaatattttaaaatatccccaaatattttagtgttaaactatatgcttctaacccaggagtcaaatatgaaatacaagcgaaatgt

SEQ ID NO: 44358 - DNA, 487 bp, Homo sapiens
  misc_feature 8, 474: n = A,T,C or G
gaaggccnctgaggcagccagcgcaggggcttcttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagacct

SEQ ID NO: 44359 - DNA, 468 bp, Homo sapiens
  misc_feature 6, 8, 29: n = A,T,C or G
ggcgcngntcttagtcgcgggctgactgntgtttatccgtcactcgccgaggttccttgggtcatggtgccagcctgactgagaagaggacgctcccgggagacgaatgaggagccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacag

SEQ ID NO: 44360 - DNA, 487 bp, Homo sapiens
  misc_feature 6, 32, 33, 463: n = A,T,C or G
atagancggcagaacattcatgagaaatatcnntgcaggttaatggtgtttatttctccagttattttatactttctaagaatacggagtctcctgtcagtgccgcataagcatgtcgtctctgtttccaaacttgtctgatttaatcaccccacattgtgaacgtgtatctatcaaaaaacatcacagtttacctctcaataaattttacaattattatttgtcaattaaaataaaatttacatacaataacaatggtctctggtaaatgtaagtattgtttcgtggttttctacatatggataatgataatactatatttaagtagcttatgaattttgaaagaaaaaaacactcctagtgtttgggaggccaaggtgagaggaccacgaggccaggagttcaggatcagcctaggcaacatctctgcaaaaaattttacaaaaacttatctgggtgtggnggcatgcaccctgtagtcccagct

SEQ ID NO: 44361 - DNA, 270 bp, Homo sapiens
gttgtgtctgatttcccctggcttattctttactttttcctccttttccaggctcagcagggagctgctggaggtagtagagcctgaagtcttgcaggactcactggatagatgttactcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatc

SEQ ID NO: 44362 - DNA, 367 bp, Homo sapiens
  misc_feature 2, 5, 30, 31: n = A,T,C or G
gnttncctgggctcggacctaggtcgcggnnttatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatg

SEQ ID NO: 44363 - DNA, 346 bp, Homo sapiens
  misc_feature 33: n = A,T,C or G
atagaccctgaggttccagtgtctcctggtaantggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagac

SEQ ID NO: 44364 - DNA, 296 bp, Homo sapiens
  misc_feature 26, 32: n = A,T,C or G
atagacccaatgcctccccatcaagnctaccnttgagtttcttcacagaattggagaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccgaaacagagatatagatcaatggaacagaacagagccttgagaaataacgccacatatctacaaccatctgatctttgacaaacctgac

SEQ ID NO: 44365 - DNA, 494 bp, Homo sapiens
  misc_feature 17, 42: n = A,T,C or G
atggccgaggacaaccntagccaaacctttacccaaataaantataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaatt

SEQ ID NO: 44366 - DNA, 353 bp, Homo sapiens
  misc_feature 5, 6, 31, 32: n = A,T,C or G
gtagnnattgcaccctatgacattggtggtnntgatcaagaatttggtgtggacgttggccctgtttgctttttataaaccaaactctatctgaaatcccaacaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttgctgttccaccaaatacaattcaaatgctttttgttttatttttttaccaattccaatttcaaaatgtctcaatggtgctataataaataaacttcaacactctttttg

SEQ ID NO: 44367 - DNA, 359 bp, Homo sapiens
  misc_feature 16, 41: n = A,T,C or G
tatggccggggggacncttgcgtactcagcacagtagtggnttagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtaggattggggtagcccatgttatgtgactatctttatgagaattttaaagtggttctggatatcttttaacatggagtttcatttcttttcattgtaaccc

SEQ ID NO: 44368 - DNA, 194 bp, Homo sapiens
  misc_feature 7, 42, 43, 46, 53, 95, 189: n = A,T,C or G
gtaaatnatttatgttttttttaacaaatttatcgtataggnngangaaacgncctgtgttttgccaaagactgtaaatatttatttatgtgtcncacaatggtcaaaatttcaccactgaaaccctgcacttagctagaacctcatttttaaagattaacaacaggaaataaattgtaaaaaaggttntctat

SEQ ID NO: 44369 - DNA, 477 bp, Homo sapiens
  misc_feature 60, 209, 469: n = A,T,C or G
atagtcccctttacttaaagaacaagaaatagtttttttataaaactttaaaaaggaaanaaaaacaggcatttataactgagggtatgaacttatatccaccaggtctcttgtccctgcacttcattttctttggaagaaaatgatgtctaaagaacaatatagaggcatttttacatacgtatttaaatgaagaggaaaatcgtggnttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgngattcagt

SEQ ID NO: 44370 - DNA, 472 bp, Homo sapiens
  misc_feature 11, 44, 45: n = A,T,C or G
tatggccgggnatctgcactggagatgagacactatgaaatgtnnctccacaagctttctgctgcttgctgtgtcttgataccattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgatttttttttttaaattgtcaaacttggtaaaaagcaccagcatggccaagtttctctagggacttcatttcattttcaggttttcaatccagctataaggaatatgtaatgggacttatatacagcacacagcaggcag

SEQ ID NO: 44371 - DNA, 314 bp, Homo sapiens
  misc_feature 41, 223: n = A,T,C or G
tatggccgggatgtgccctgtattaaacatacacaagtganttgccaggcatgggaatgtaacttccgagtaaatgctttggtttgttcagaatacactatgaacttctttccaaagacgggttgtggtaaatagtggatattttgattataagaaatagagtttccttgaagctttagctggagatacagcaatagtgtggtgttcctacaaatatcacagngtattcaaacatatttttctatcaaaaatcatttttgtaaaagctgtgtgtttttatccaacttgtgataataaatgttctttattttaga

SEQ ID NO: 44372 - DNA, 474 bp, Homo sapiens
  misc_feature 3, 17, 29, 40, 440, 448: n = A,T,C or G
tanggccgggaatgtcncttgatctcagnatttctttttnaagtccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgnattggggnggagttttctgaatggctataagctg

SEQ ID NO: 44373 - DNA, 487 bp, Homo sapiens
  misc_feature 6, 9, 34, 424: n = A,T,C or G
gcaacngcngaaggaaaaactttcttctttaagntttctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgngggagaggacttccaaatgtgggtacctcagctatatcactgcccaacatcagaaaacctgac

SEQ ID NO: 44374 - DNA, 411 bp, Homo sapiens
agagtcccgttttttatttgtttatttatttatttttgagacagagtcttgctgtattgcccaggctggagtgcaatggcacaatcttggctcactgcaacctctgtctcctgggttcaagcaattctcctggctcagcctcccaagtagctgggattacaggcatgtgccacctggctaatttttgtatttttagtagagacagggttttgccatgttggccaggctggtcatttactaattccacctcacacttgatactagagtagtgtttaccctagctggtactgataagttatgtgatagcaccaaggtgaaatgcaggagaggtgtgaacattggagttttcaaggttttacctgatggcttttacgaagggaagagattctagactcactaggtgtttttagg

SEQ ID NO: 44375 - DNA, 144 bp, Homo sapiens
  misc_feature 136: n = A,T,C or G
gacacaccacaatggggctcactcacccaccatattaacaacataaaaccctcattcacacgagaaaacaccctcatgttcatacacctatcccccattctcctcctatccctcaaccccgacatcattaccgggntttcctct

SEQ ID NO: 44376 - DNA, 499 bp, Homo sapiens
  misc_feature 24, 461, 463, 498: n = A,T,C or G
cgacttgagcatgttactgacagngggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgngnactgcccaaagcagcacttataaatcagcctaacnc

SEQ ID NO: 44377 - DNA, 489 bp, Homo sapiens
  misc_feature 33, 473: n = A,T,C or G
ataggccgatgtacagaactgaaattcgaattncgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcatggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggnggaatgaagaaaaaga

SEQ ID NO: 44378 - DNA, 452 bp, Homo sapiens
  misc_feature 5, 27: n = A,T,C or G
ctagnatatagtaccgcaagggaaagntgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 44379 - DNA, 500 bp, Homo sapiens
  misc_feature 23, 81, 204: n = A,T,C or G
gtgtgtgtatacacgtgtgtgtntttgtgtacataaaccctccggtctgcgcatctttgaattctctgccaatttcgaggnggttccccccaccctagggacaatgtcagctttattaaattgggcacagcctccctagaaggtgaaacaatgcttttaatgttctgattatatattaatgaacaaccaggccaaggggcactntgccaaaaaagctacaaagtgagaaagccaccaatatcagagtgaactttgcactctgaaagtgtgaatgatgttgggtgaaagagtttatggcgcaaggggagcaacctggaatctctttgatgttgtgtagcatcctggccccattagactttgggccttcccgtttaactgcatctttgctggcgagggcagtgctgaggtgtggtctgaaatatagagggacctcagccacagaggactggcatacctgtgctgggcagggggaccgttggccatttctatctgttttcaat

SEQ ID NO: 44380 - DNA, 306 bp, Homo sapiens
  misc_feature 5, 32, 58, 142: n = A,T,C or G
agggnccttttttttaatgttaattattttanttcactggatatttatagcattaaangtgatcttataatgaagagatatattggagttttaaaaagaaaatataaatttggagagaatgttcacattttacaatcttggngggcatttttttttatgaaaatgtttgttaaaaaattaaatgtttttggccgggcgtggtggctcacgcctgtaatcccagcactttgggaggccaaggcgggtggatcacctgaggtcaggagttcaagaccagcctgaccaacatggtgaagccccgtatct

SEQ ID NO: 44381 - DNA, 490 bp, Homo sapiens
  misc_feature 5, 7: n = A,T,C or G
ggaancntggagactactggattgacccctttaaggctgcaccttggacgccatgaaggttttctgcaacatggagactggcgagacttgcgtctaccccaatccagcaaacgttcccaagaagaactggtggagcagcaagagcaaagagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaag

SEQ ID NO: 44382 - DNA, 483 bp, Homo sapiens
  misc_feature 478: n = A,T,C or G
ggggccaccagagtatctagcgactgaagcttttggccaagccgtgtggggtgcgcctgagcggggaagcccgcaaacaggtggaggtcttcaggcagaatcttttccgggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggaganggtga

SEQ ID NO: 44383 - DNA, 306 bp, Homo sapiens
  misc_feature 22, 279: n = A,T,C or G
gtgtccctgtgggtggacgtgnctggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgnctgagaggtggtatgcagatcttcgtg

SEQ ID NO: 44384 - DNA, 415 bp, Homo sapiens
  misc_feature 30, 31: n = A,T,C or G
gagatcctggttcagtgcagcctcaacctnntgggctcaagtgatcctcccgcttcagcctcccaggtggctgggactacaggtgcatgcccttctaatttttttatttattttgtagagatggggtctcaatacgttgcccaggcataattgttgaacaataggataatcgtggaaaatccattcaaatgcttgtgtgtagagaaagtaaatcaaataggaatcttcagtaacacagagcaatgttcattcaatttattttattttatttttatagatcctgggggtacaagtgcagttttgttacatcaatatattgtctagtggcttttagtgtgcccattgcctaaatagtgaatgtcgtacccaataggtagttgttcattcaatttaaatagttgaaaaataagtttac

SEQ ID NO: 44385 - DNA, 438 bp, Homo sapiens
tggcaatcaccaaaacaattaccagccatactaaaggagaacattggagaaaacaggaggagatgttaaagtaacccatcttgcaggacgacattgaagattggtcttctgttgatctaacaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaagggaaagaacctcccaaaaaggtttttgtgggtggattgagcccggatacttctgaagaac

SEQ ID NO: 44386 - DNA, 601 bp, Homo sapiens
ggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggacgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaacttctcagccgatgtgaaggaagcatgaggagggatcgtcagattcagatttagaatagtgttcccgtttcagca

SEQ ID NO: 44387 - DNA, 406 bp, Homo sapiens
catctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtgcattttcatattagactttttgttaaataaacttttgtaatagtcaagaaaaaaaaaaaaaaaaaaaa

SEQ ID NO: 44388 - DNA, 306 bp, Homo sapiens
acttctttgttgaatgcctcactaatggcaagtttcaagatgttttgggtgacaatgcacacatgctgggcaaaagggtgatggccagtggctgggagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatccca

SEQ ID NO: 44389 - DNA, 163 bp, Homo sapiens
ttggttggtttcctgaagcgcagcccctgtgaataacaggtggcttttcatggatgtctctagtcagagaaaaatgataaaggcttaaattgaggattaacagaagcagattaacctcagaaatcctgtctgactggcagatttcaagtaaaaaaaaaaaaaa

SEQ ID NO: 44390 - DNA, 531 bp, Homo sapiens
ggtgatgattattgacaattggttcatttttataggtgttgaccgttatgcctataaataagcctcctatagacatacagaaatcatatcctgtggaattagaatataagacttggtaaaagagattttcaaagtattttacttaacttgtatacttgaaatcatttaatccagactgaagttgtaaaagccagccagtgttttcaatatagacttccatgtttgaccatctgaaaatgaaaaacactaaaaacatcacatgctgtttaggagctggaaattttaatatttgacttcaagtagatggtttttaactcctgaaatcgaactacgtttaagtttgtatgtttattacctgtttgagcacttaggtgcaattgtgggagcggggatgtcaagttcatttatgtgactctttggctcaacttacataatctttgttttgatatcacagttgtctaattattttactttgtagcttaaggcaggctgaattgttgataaaaatggaaaaagtagtatattgttata

SEQ ID NO: 44391 - DNA, 526 bp, Homo sapiens
actggcatagggcgagctcgaagggtagattagggctgaacagggggcctagacaagggttctttaaagaaagacagcgcaactttgaatgctttcttacttgttttgtgacctaatttatgtggaagattgttatttcattaggatttagtaaaatttttttttctgattctaaacttatggtgaaaattgagctgtacagatattcttttgattgcaattgggaacatttggaagaacaacagtcttacttgcctgtacaatatagagacatatgaatagtcataacagttttcaacttggtcttgtttctggtaaactatattcctagaaacatagtttgaacaacttggctttggtaggctggcaaattgccttcatggaaaaataatctacaaaagatgggttaattggatggcttacatgataattttccctgggaacaacttaggaagggaaatatcttttttcctaaatgcttaaataccgggaaattgctctgacaaatgggaagggaccattggca

SEQ ID NO: 44392 - DNA, 545 bp, Homo sapiens
tgccaactgtgagaaaagggctgtgatcgtacagagatctaacggggccgaactggtcgccgagggcatgagcaggttcacttacactgttctggtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttctcttcttcttttttaactgaaagctgaatccttccatttcttctgccatctacttgcttaaattgtgggaaaagagaaaaagaaggattgatcagagcattgtgcaatacaggttcattaactccttcccccgctcccccaaaaatttaaattttttttcaacactcttacacctgtatggaaaatgcaacctttgtaagaaaccaaaataaaaatggaaaataaaacc

SEQ ID NO: 44393 - DNA, 223 bp, Homo sapiens
tgtgagaatgttcagtcatatgcttcttgcaatgcttattctgtaatctgaaacgttacaagaaaaggtttttcagatataaagagaattacttcaaattgagtaattcagaaaaactcaagatttaagttaaaaagtggtttggacttgggaacaggactttatacctcttttactgtaacaagtactcattaaaggaaattgaataaaaaaaaaaaaaaaa

SEQ ID NO: 44394 - DNA, 416 bp, Homo sapiens
taaagagtcaaaccttttatttcaggggctgcagaacaaatcaagcacatcctggctaatttcaaaaactaccaggtctttattggtgaaaacatgaatccagatggcatggttgctctattgggactaccgtgaggatgggtgtgccccatatatgattttctttaaggatggtttagaaatgggaaaaatgttaacaaatgtggcaattattttggatctatcacctgcatcataactggcttctgcttgcatccacacaacaccaggacttaagacaaatgggctgatgtcatcttgagctcttcatttattttgactgtgatttatttgggaggggagcattgttttaagaaaaacatgcatgagggtgctaaaaataaaatgcatttaaacccaaaaaaaaaaaaaaaaaa

SEQ ID NO: 44395 - DNA, 272 bp, Homo sapiens
tgagggcaagtaagcctgtggaaggtaagatttggaaagaaggctgctgttgggcaaagaagcggaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgtaaaaaaaaaaaaaaaa

SEQ ID NO: 44396 - DNA, 515 bp, Homo sapiens
ggcctgagatgtctcgctccgtggtcttagctgtgctcgcgctactctctctttctggcctggaggctatccagcgtactccaaagattcaggtttactcacgtcatccagcagagaatggaaagcaaatttcctgaattgctatgtgtctggggttcatccatccgacattgaagttgacttactgaagaatggagagagaattgaaaaagtggagcattcagacttgctttcagcaaggactggctttctatctcttgtactacactgaattcacccccactgaaaaagatgagtatgcctgccgggtgaaccatgtgactttgcacagcccaagataggtaagtgggacgagcatgtaagcagcatcatggaggtttgaagatgccgcatttggattggatgaattccaaattctgcttgcttgctttttaatattgaaagcttatacacttacacttatgcacaaaaggagggtataataatgtagcatggcatgactctttataatctac

SEQ ID NO: 44397 - DNA, 360 bp, Homo sapiens
tttagaaagagcattaatagcttcatttcatatggacataagtaactcccaaacacttatgtagaggactaaaaatgtatctggaatttaagaaatctgaaccagtctgcaagtgactgtgtttgtattactgtgaaaataagaaatgtaggtaattacaatttaaagagattccacataacttcttaatttctacattcccttccttactcttcggggggttcctttcaagtaaagcaacttttccatgctcttaatggattccttttaggaggaatcccggaaggattagattgaatgggaaagcactttgccatctctggctagggggcacaaattggaatggcccctggtcacata

SEQ ID NO: 44398 - DNA, 391 bp, Homo sapiens
gtgaggtgccgcatttcatctgttttcattctctgcgcctttcgcagaggttccagcagcggtatgttgggccagagcatccggaggttcacaacctctgtggtccgtagaagccactatgaggagggccctgggaagaatttgccattttcagtggaaaacaagtggcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactaagatatgtttgcaataaacttatgaccaaaaaaaaaaaaaaa

SEQ ID NO: 44399 - DNA, 587 bp, Homo sapiens
atataaatatatacgaagacataatactgtacccctcaaatcaattattatttgtttatttaaaacatttaaggcaaaaaatgagacaaatatcaggaaagtaattttatacataagctagataattgcctatagctgcgtatgctgtgaaataatttctgtttgaaaagacaggaaaaattatatggcaaaaccatagtgcagtaataaatttgccatgtttagtaaacaaaatatagttcaatgtgctgaagcataccaagaggcagaagaatgtggtgacactgtagtgtagaggagggcttagtttggctgctatcaaaataccatagattgagtggcttacaaataacaaaaaaagatttcttactggtctagggggttggaaggccaaagcagaggccaggatggtctggtttggggagggccttttgcggtgcagactgtgggttttggataagccatggggaaagagggagagctcttttaggtccttttataagacactaagcctatcatgaggcctttctatgacacctaatacctctgaggtccctactaataccattacttgaagtacgattcaa

SEQ ID NO: 44400 - DNA, 180 bp, Homo sapiens
tttctctccctgaaagattagattgggctggagaagtggcaaaattagtggccttggtcgagagggcccttctgatgaatgtggcgctgacgagtttatggcaagcactttgacagacattattgtgcaaatgttgctgacttactgtttcaacaaaccagaagacaagtaactgtatga

SEQ ID NO: 44401 - DNA, 553 bp, Homo sapiens
gattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacctaaaagtaggttcttatcaagggtctctaacagtgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattcggactacacataaaaataagataacc

SEQ ID NO: 44402 - DNA, 193 bp, Homo sapiens
aatggggctcactcacccaccacattaacaacataaaaccctcattcacacgagaaaacaccctcatgttcatacacctatcccccattctcctcctatccctcaaccccgacatcattaccgggttttcctcttaaaaaaaaaaaaaaaaaaaaaaaaaaaaaaaaaaaaaaaaaaaaaaaaaaaaaaaaaa

SEQ ID NO: 44403 - DNA, 196 bp, Homo sapiens
ggggtgggacgacagtgaaatctagagtaaaaccaagctggcccaaggtgtcctgcaggctgtaatgcagtttaatcagagtgccattttttttttgttcaaatgattttaattatgggaatgcacaatttttttaatatgcaaataaaaagtttaaaaacttaaaggaaaaaaaaaaaaaaaaaaaaaaaaaaaa

SEQ ID NO: 44404 - DNA, 418 bp, Homo sapiens
gggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtcgaaaaaaaaaaaaaaaaaaaa

SEQ ID NO: 44405 - DNA, 477 bp, Homo sapiens
gcgttaactggttccactggaagggccacgaacactcaatccagtttgctgagatgaagctgagaccaagcaacttcagaaatcttgaaggcaggcgcaaacgggcataaattccaggggccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtcgccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgta

SEQ ID NO: 44406 - DNA, 183 bp, Homo sapiens
actgccaagactctgcgagtcgaactgtaaatccgccgaaagcagggctgacatacccgagaaaggtgaaatggaaaaccaaagagggacagctctgtggaaaataggaaaaaaaccttggagagagaggaaaaaataagacccgccatgagcaggcgaagcagccgccaccaatgaaaaaga

SEQ ID NO: 44407 - DNA, 480 bp, Homo sapiens
tgaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaaaaaaaaaaaaaaaaa

SEQ ID NO: 44408 - DNA, 323 bp, Homo sapiens
aatgaaagtgtaagaatgctttctgattcaacaaatttgttatcaaactgtttccttatcctcttttctgatgtagcataaaaattgtcccggtttgagttataactgccagtagatgaccagtcacaagtgaaccacttctcagttgccaatctttgctcatattaaaaacaacttacaaatacttagtttttgtatctaatctctgattattaaaatgtttataaagtttatttttaccaaagagatgcaattcgttatgagaaagtattgcataataaattttgttttataaaaaaaaaaaaaaaaaaaaaaaaaaaaaa

SEQ ID NO: 44409 - DNA, 496 bp, Homo sapiens
ttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagc

SEQ ID NO: 44410 - DNA, 222 bp, Homo sapiens
gaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcgaaaaaaaaaaaaaaaaaaaaa

SEQ ID NO: 44411 - DNA, 396 bp, Homo sapiens
ctttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgaaaaaaaaaaaaaaaaaaaaaaaaaaaaaaa

SEQ ID NO: 44412 - DNA, 435 bp, Homo sapiens
gggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaactttttttgagtaataaaaatgaaaagacgctgtaaaaaaaaaaaa

SEQ ID NO: 44413 - DNA, 491 bp, Homo sapiens
ttaggttgagaaatcagtaatcaagtttgggaggatttctgtgtttttcaaaggcaggattcttagtgagagtccaaggcatgttggacctttatcccagctgttttctatgtacttcatgtttagggatcatgtcccaaaggatggctgtcttttacgttagtctccacttgatgaaagtgggctttactgtaatatttttgcataggatgttcaatacattcgttgttgatatcatttaaattttttctctctgctttttacacagtcaaaatttgctgtgcgatgtcacaattgtggcagaagacatggaaatttctgctcatagagtggtgctggccgcctgtagtccttattttcatgccatgtttacaggtatgaaatattttagttataggcattttaaaaaatgtattcagatctgtgcttttcttaccacattttcttttgttattgacattttacttttatgaaatgaagaattatagtgg

SEQ ID NO: 44414 - DNA, 421 bp, Homo sapiens
agctgagactgttccataattgataaaagacatgagtctagatatgtgaagcaaagtattatcaaggagtatacataaaaagaaattcattcatagacaggttgtttaaagatgcagaataccaaaggacatgatcttaaaaacagtcatgaaaaggcaaatcatttataaaatctcacaagtagactaaaaatagacgtctcaaacataatcatgggagcaaaagtctgtaaaataagaaaaagtaactattagcctaaaattgcatacctcagtgaatttatctttcagagcaaagcagtatgtttttgtaaaggctaaaataactagcttactgccaaaataacaactttacggatatctttacttaaataattgtctaaaagatatacttcagaaaaaaaaaaaaaaaaaaaaaaaa

SEQ ID NO: 44415 - DNA, 413 bp, Homo sapiens
tctcaattttctttatgctagacatataaattatttttcaaactgtatagatttggggtaaaaagttgtctcagttcctctcccaattgcaatgagaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatcttaaaaaaaaaaaa

SEQ ID NO: 44416 - DNA, 440 bp, Homo sapiens
gtattgcataattagatactcatattaacatattgaattcagaaaaagttagcaagccaagatggacattctctgtagcactattttaaattataatgaatgatcacataaaactctttagtatttatctaaagtaattattactctacttcatttgtttatctaaatcagtgatcattgatgtttgaactttttggcttaaatgtttattttgtttatactacttgctagagtaaaataaatttaatacatgaaaaactctacacaatttaaaataggttataatttgtcaatacttatgttttaaaatatttttagaaggaggagtgctgtatattattaaaacaattttctgaaattggttaatatatctttgattttaaaatgacatatatgtggattacaatgaatcaaatgtcctaaaagatgtcagataagaa

SEQ ID NO: 44417 - DNA, 405 bp, Homo sapiens
aaagggaccagagagaaggagttacctgcagtcttttgtttttttaaatacttagaacttagcacttgtgttattgattagtgaggagccagtaagaaacatctgggtatttggaaacaagtggcattgttacattcatctgctgaacttaacaaaactgttcatcctgaaacaggcacaggtgatgcattctcctgctgttgcttctcagtgctctctttccaatatagatgtggcatgtttgcttggacagaatggtaatcatacagagaatccttgatggaattatatatgtgggtttacttttgaatggtacaaaaggaaataactttaaaactatctcaagagaaaatattcaaagcatgaaatatgtgctttttccagaatacaacagtatcctcatga

SEQ ID NO: 44418 - DNA, 399 bp, Homo sapiens
cagcactgacccctttttaaggaatacaaattttctccttcatcacttaggtgttttaagatgttggccttaaagtttttcttgggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgctgccaggtcattcttcctcttttttttttaattgggtagggacacccaatataaaaacagcaatatttgacaatgtggaattaccaaattaaaagagactactatgaatgattcatatgttttctatattgaataaacagtggccatagataccttttggtt

SEQ ID NO: 44419 - DNA, 570 bp, Homo sapiens
ctctctccctactgctgctacacaagaccctgagactgatctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcggcaggagatgaagagctaaagtccaagagaggatccgagaacgctctaagcctgccacgagctcaatagggaagcctgtgatgactacagactttgcgaacgctacgccatggttatggatacaatgctgctataatcgctacttcaggaagcgccgagggaccaaatgagactgagggaagaaaaaaaatctctttttttctggagctggcacctgattttgtatccccctgtagcagcattactgaaatacataggcttatatacaatgctctttcctggatattctctggctggctgcaccccttttttcccgccccagattgataagtaatgaagggcactgcagggagggtcaaaggagagcaacatatg

SEQ ID NO: 44420 - DNA, 391 bp, Homo sapiens
  misc_feature 5, 6, 7, 17, 23, 26, 39, 45: n = A,T,C or G
cgggnnnaggggggaanggccanatnaaaactccccaanatgggnatggctcgggccgaactggctttgctgaccgggagaaacgagatggttttgaagctggagatatttcggatgataatctggctcactttccctgtggctatgttctgggtttccaatcaggccgagtggtttgaggacgatgtcatacagcgcaagagggagctgtgccacctgagaagcttcaagagatagaggaattcaaagagaggttacggaagcggcgggaggagaagctccttcgcgacgcccagcagaactcctgaggcctccaagtgggagcctagcccctcccctgatgaaatatacatatactcagtccttgttattcaaaaaaaaaaaaaaaaaa

SEQ ID NO: 44421 - DNA, 373 bp, Homo sapiens
aagggaaaatgtgtgcaggtctactgcattaaatcctgtttgctcctcttttggatttacagaaatgtgtggaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggctttgaatttggatacatttattctgtcactatcacaaaatcatctatatttatagaggaatagaagtttatatatatataataccatatttttaatttcacaaataaaaaatcaaagttttgacaaaaaa

SEQ ID NO: 44422 - DNA, 456 bp, Homo sapiens
agaatacagggatcttggatttcagacacattgtgtttcttcataaaaagtgtacttaaaagctgtaacgctggatattgactatccttagttgagtcactgaggtttaaacacaatggtaagtcttaaagtctgctatttacagagcattgaatctgtaccaatttgcaatagaaagccttcagtatgcaagaagtttgcatggggtattaagaacacagcctaaataaggcatttgatctaatctgcaggaagaattttcttccccaaaacagaattataaaagcttactttaaacagggaggcagaataattcttttaggaaaccatttcattctgggttctactaacctataccatctggagaattctaggaagaataataaaagcccggggattccacagcaaactgacataccataaagacggagtcctaacatcttggagccggccggc

SEQ ID NO: 44423 - DNA, 289 bp, Homo sapiens
gtttaatccacttcctttcttcttcttctaaaatattgggcactcgggtatcttttaaaattcacagaagaaaaattccgtttggtagactccttccaatgaaatctcaggaataattaaactctagggggactttcttaaaaataactagagggacctattttcctcttttttatgggttagactgtggatgatttattaaaatgctttaataataggaaaaggggaaagtatttatggtacattattttcatagattaaataaatgtctgtataataccaaaaaaaa

SEQ ID NO: 44424 - DNA, 538 bp, Homo sapiens
gagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcggagtcatgggagagccacacttgatggtggaatataaacttggtttactgtaatagtgtgctgttcatggaaaccgagggctgcatcttgtttatagtcatctttgtactgtaatttgatgtcacaacattaaaagtactgacacctgagt

SEQ ID NO: 44425 - DNA, 531 bp, Homo sapiens
ggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaaatgtcattaattttg

SEQ ID NO: 44426 - DNA, 600 bp, Homo sapiens
ggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagtttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacagggttgacataatacttctccatgcagtaagtcagtcattttttccacttggtaactgtaat

SEQ ID NO: 44427 - DNA, 209 bp, Homo sapiens
taaaaaggtgttttagcttgaaagaagcaacaataaaaccaatagctaatttctcaacaaaatgatgaaaaccaggtgacaatagaatgacatctttaagtcagtgaaagaaaataaatgtcaacacataatccttcatcctgcaaaaaaatacttcaaaatattaagataaagatattttcaaaaaaaaaaaaaaaaaaaaaaaaaaa

SEQ ID NO: 44428 - DNA, 484 bp, Homo sapiens
gcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactacttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttagggaaaaaaaaaacaaaaaatctggatatttatttcaaa

SEQ ID NO: 44429 - DNA, 496 bp, Homo sapiens
tagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttgg

SEQ ID NO: 44430 - DNA, 491 bp, Homo sapiens
aaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatctgaagatgaagaaattaaaagactgcttcagggagacacacccatgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagg

SEQ ID NO: 44431 - DNA, 229 bp, Homo sapiens
ataggaataagctctagttcttaacaaccgacactcctacaagatttagaaaaaagtttacaacataatctagtttacagaaaaatcttgtactagaatactttttaaaaggtattttgaatactattaaaactgctttttttttccagcaagtatccaaccaacttggttctgcttcaataaatctttggaaaagctaaaaaaaaaaaaaaaaaaaaaaaaaaaaaaa

SEQ ID NO: 44432 - DNA, 368 bp, Homo sapiens
ccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaaaaaaaaaaaaaaa

SEQ ID NO: 44433 - DNA, 370 bp, Homo sapiens
catccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcagaagcagccgtgggcaaaatacaatttcatttaacaaattgaaaaaaaaaaaaaaaaaaaaaaaaaa

SEQ ID NO: 44434 - DNA, 166 bp, Homo sapiens
caggagtatgacaccttcctgggggctttggatttgatctacaatgaagccctcaagggctgaaaataaatagggaagatggagacaccctctgggggtcctctctgagtcaaatccagtggtgggtaattgtacaataaattttttttggccaaaaaaaaaaaaa

SEQ ID NO: 44435 - DNA, 510 bp, Homo sapiens
tttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttgggtttactaaaaaacgcaacaatcagatacggaagacctcttatgctcagcaccaacaggtccgccaaatccggaagaagatgatggaaatcatgacccgagaggtgcagacaaatgacttgaaagaaggggcaataaattgattccagacagattggaaaagacatagaaaaggcttgcaatctattatcctctccatgaggctcgttagaaaggaaaaaatgctgaagaacccaagtttgaatgggaaagctcatgggcttcattggggaaggcagtagttctggaaaagccactggggacgagcagggctaaagttgaccgagctg

SEQ ID NO: 44436 - DNA, 168 bp, Homo sapiens
tataagatctgaacttttcatctgcagaggcaagttaaatatttgacattgtgacttgactgtggaagatgatggttgcatgtttctagtttgtatatgtttccatctttgtgataagatgatttaataaatctctttaaatacttaaaaaaaaaaaaaaaaaaaaaa

SEQ ID NO: 44437 - DNA, 490 bp, Homo sapiens
aggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaagtgctggccggaatactgggagggaacaagcatgatcttgtactgggatatttaaatatccacaggactcactttttccaaatgatcctaggtaatgcctagaaatatcttctctaacctg

SEQ ID NO: 44438 - DNA, 334 bp, Homo sapiens
atttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttccc

SEQ ID NO: 44439 - DNA, 610 bp, Homo sapiens
ggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccctttcacatcaaagaactactgacaacgaaggccggcctgctttcccatctgtctatctatctggctggcagggaaggaaagaacttgcatgttggtgaaggaagaagtggggtggaagaagtggggtggacgacagtgaaatctagagtaaaaccaagctggcccaggtggcctgcaggctgtaatgcagttaatcagagtgccattttttttggtcaaatgatttaaatatgggaagcccaatttttttaattgcaaataaaaggttaaaaccaaaaaaaaaaaa

SEQ ID NO: 44440 - DNA, 630 bp, Homo sapiens
gatatagtaccgcaagggaaagatgaaaaattataaccatgcataatatagcaaggactagcccctataccttctgcataatgaattaactagaaataactttgcaaggagagccaaagctaagatccccgaaaccagacgagctacctaagaacagctaaaagagcacacccgtctatgtagcaaaatagtgggaagatttataggtagaggcgcaaacctaccggcctggtgatagctggttgccaagatagaatcttagttcaactttaaatttgcccacagaaccctctaaatccccttgtaaatttaactgttagtccaaagaggacagctctttggacactaggaaaaaccttggagagaggtaaaaaatttaacacccatagaggctaaaagcagcaccaattaagaaagcgtcaagctcaacacccctacctaaaaaatcccaacatattactgactcttacacccaatgggccatctatcaccctaagaagactatggtagtataggaacatgaaaccttctcctccgataagcctgcgcagattaaacactgactgacattaacagcccatttctacatcaaccacaggtattattaccttactgcaacccacccagggt

SEQ ID NO: 44441 - DNA, 125 bp, Homo sapiens
acctgagcgctgacttttactctcctttgacttggaactgtcttatttttggggtgtaaatggctattgccggaaattgctaataaaactgatgttcccattttacaaaaaaaaaaaaaaaaaaa

SEQ ID NO: 44442 - DNA, 530 bp, Homo sapiens
tctagacaagctgattctgtatcacctgattccaggagatttcattggaaaaggatttgaacggtggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctggtggaaacgatcaactgctggaaatacttaataaattaatcaaatacatccaaattaagtttgtcgtggtagcaccttcaaagaaatccccgtgctgctatacaactaaaattataaccaaagttgtggaccaaaaattaaagtgattgaagcagccttcaggctattatcaaactgagggcccacctaacaaagtcaaaattgaaggggacctgaatcagctgattaaagagggggaacaatactgagggatccatgggggccattattaaaaaataccccaaatcctggtggagtgc

SEQ ID NO: 44443 - DNA, 610 bp, Homo sapiens
caacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaagggagagagaaaatatatatgataatcatttccacttaactaatttttacttctagcaggtaaatgtaggtagcagtgcaggggtgatctctgcttcctgtaccttgacatgcaaaagggctctcctaatactccacattcaaactggaagagg

SEQ ID NO: 44444 - DNA, 291 bp, Homo sapiens
gaggtcttcaccaaagtgtacaaagccaaataccccatcgtcggctacactgcccggagaattctcaatgaggatggcagccctaacctggacttcaagcctgaagaccagccccattttgacatcaaggacgagttctgatgttccccctgcaggagcaggttcttgggagcgtgaggcaggaagacactaggtgctgaatctcctgcaaaactggctgcctgggggccctgagccacccagatctgaataaaacagatgcttaccctggaaaaaaaaaaaaaaaaaaaa

SEQ ID NO: 44445 - DNA, 428 bp, Homo sapiens
tgttgttgtccgtgttgttactgttgttcttgtcatcaggtttgattttgggtccttgccctttccgtctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttaggaagaagaggagaacagctaataaactgtattgtaaaatccaa

SEQ ID NO: 44446 - DNA, 230 bp, Homo sapiens
cagcctttagtttgtggcaggatgctacataatatacagacgctcattgtgtggtttaatgtgtagcttcatgtgtattaataaaaatatataagaaactcattaagctcctcaattcatggatgattttgccacaaatgaggcaagagtaaaaagtagcaatcaatgtaaagcaaagctactaagtaaatagcttagcaaaaaaaaaaaaggaaaaaaaaaaaaaaaaa

SEQ ID NO: 44447 - DNA, 289 bp, Homo sapiens
ggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctacaaaaggctagctcggcactacactagggaatttgctcctgttctgtcacttgtcatggtctttcttggtattaaaggccaccatttgcacaaaaaaaaaaaaaaaaaaaaaaaaaaaaaa

SEQ ID NO: 44448 - DNA, 495 bp, Homo sapiens
catttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgcaaaaa

SEQ ID NO: 44449 - DNA, 380 bp, Homo sapiens
gagaaatcctccacactgaaaaaaaactagtagttttaatttttttggaatcatattttctgaggtgtaactggctttcattagatgatcatacttttcctgacatttttacaatgtattctttctttaaatataaaaactgacaagataaaaatagtgtttcaacttcttagcctatttgtgatttttctgttttcctctgacccatcattgattctataaaaaagtgccaggccaagaaacaatagttagagtaattcttcctttaagttctttcagcagtcttgccaagcaagcatgtatcattcctgatgtacttctaccattgacagcaagaagaatatcaccacatctaaaaaaaaaaaaaaaaaaaaaaaaaa

SEQ ID NO: 44450 - DNA, 195 bp, Homo sapiens
gaaggcacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacagaaaaaaaaaaaaaaaaaaaaaaaaaaaa

SEQ ID NO: 44451 - DNA, 373 bp, Homo sapiens
ctgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaaaaaaaaaaaaaaaaaaaa

SEQ ID NO: 44452 - DNA, 600 bp, Homo sapiens
aaacaatatcaaataagcataatatgctacatattgttaatgctatgaagaaaaacatgtaacgtaatggtgccccagagaatggcggaatgggatggtcaagggaaggtctctctggtaagaaaaaacgacttacatgaggcaacaagccttgaagacaccttagagattattccaggttgagtaaacggtgttgataacttaagaagagatcatgctttgtgcattagaagagcagcaagtagaccagatgactggcttttacagtaagagaaaaggaggcagagtagaaggatgcagatcatgtaggatttgtagcccctttgagaactttagattttattattctgcatgagattggaaaccactggagtctgaggcaaagaacatataatttggttactttctaaagcaattgctctgagagcttaaaaaaagaataaaatttaggaaggcaaaaggggaagcaggaataataatcagggcaacttcaatcatttggaaggaaacaatggtgacttggccaaggttgtcggagtagagtggagagactagattaagtgaccttttgaggctgggctagcaagatttgttgtgata

SEQ ID NO: 44453 - DNA, 100 bp, Homo sapiens
gatttttttttttttacaggtcatcagagttttttgcaaagggagttttatttttttgaaagggctttatcttaacttaaaggggaaggcgctccccctg

SEQ ID NO: 44454 - DNA, 279 bp, Homo sapiens
ggtaaagggacagatagtaaatatttttggttttgcaggccctgtggtctctgtcatcatagcacaaagacatcccgaattgtctactatgatcacagtttttcttaatgaaacaaaacgtgtgtgcatatttgggcatagaaaatggtttggtatgaaaatcattaacagtccttattaacactccttatcccaggagcgagatgtgtgtgtgttttacattatttcccttgatacaatttaaaacttataaaaaaaaaaaaaaaaaaaaaaaaaaaa

SEQ ID NO: 44455 - DNA, 553 bp, Homo sapiens
cggtaacacaatgtctcccttgtgcaaagtaactctcttagtgagtgctcagatatgtggggaaaaagtatttggtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcgaactgaaacgtctcctgcatcagcatgatggaagtggttcattgcatgatattcaactgtcattgccatccagtccagaaccagaagatggtgataaagtatataagaatggaagattttattaaatgaaataaaacaactt

SEQ ID NO: 44456 - DNA, 330 bp, Homo sapiens
acacaaacagaagaagatccagcagttataagattttgcatttgccaatgtcccaattggattattggcctctgagtgaggttctttcagaacagagctaggaatacagtttccagggcctaataagcaagcatagccagaagacaaagacgattttgagaggtatttattcacctttaattccaggggctccgaggaaaacagatttttcctaaaatgggatttgtggtgcattttctgtttccccaaggagtcccaggccaccggaagccattctaggtgcaccaagagtggcaagacacagtaaaaaaaaaaaaaaaaaaaaaaaaa

SEQ ID NO: 44457 - DNA, 410 bp, Homo sapiens
gagcagaaccaacctccgagcagtacatgcaaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgtaaaaaa

SEQ ID NO: 44458 - DNA, 597 bp, Homo sapiens
gtcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaa

SEQ ID NO: 44459 - DNA, 241 bp, Homo sapiens
ggaggccgaggtgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactccgtctca

SEQ ID NO: 44460 - DNA, 589 bp, Homo sapiens
ctaaagcaatctgtagatttaatgtactcgctatgaaaatctcgctgatgttttttgcagaaatagaaaatcccaccctaaagttcatatggaattgcaacagacctcaagtagtcaaaacaaccttgagaaagaacaaaactgaaggatttaacaattcctgatttcaaacttgctacagttccagtagtcaaaacagtgtggtactggcctaaaggcagatatattgaccaatggaatagaatagagaccccagaaataaatccttgcctaaatggtcaagtgattttttgacaagcgtgcccaaaccactcaatggggaaaagacagtcttgttaagaaatgatgaagtgaaaaactacataggcatatgcaaaagaatgaagttggacccttgcctaataacatatagaagaattaactcaaaatgaataaaaaacctaaatgtaagaactacaactataaaaattttaggggaaattgtaggataaaatcttcaagacgttggactttaagatgacttcttggctatgacacccaagggcacaggccaccaaaaaaaaaaaaaaaaaaaaaaaaaaaaaaaaaa

SEQ ID NO: 44461 - DNA, 413 bp, Homo sapiens
accaaagcagcatcttgtattgccgcagttctagcttcaccttcacgatgtttcccttggtcaaaagggcactaaatcgctccaagttcgaagcattcagcaaacaatggcaaggcagagcaaccagaaacgtacacctgattttcatgacaaatacggtaatgctgtattagctagtggagcactttctgtattgttacatggacatatgtagcaacacaagtcggaataagaatggaacctgtcccctgttgcagagttaccccaaaggaatggaggaatcagtaatcatcccagctggggtaataatgaattgttaaaaaacagctcataattgatgccaaattaaagcactgtgtacccattaagatatggcattattgaagaaataaagtacatttgaaaccaaaaaa

SEQ ID NO: 44462 - DNA, 491 bp, Homo sapiens
ataaattagagtagataatgggtcaccttgatagcctttgtttacattacttgtatatgggcaaaataagtattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggcaggagtcgagatcagcctgccaacatggtgaaccctgctcactaaaaatataaaaattagccggcgtggtggcagccctgtaatcccagctctcgggaggctgagcaggagaacacttgacccaaggggcagaagctgcagttagcaagatcgcatcattgcactccagcctaggggacaagagcgcgagacttcatctcaaaaaaaaaa

SEQ ID NO: 44463 - DNA, 448 bp, Homo sapiens
taatatctttttcatatattatttatcaaagtatgaagatgagtatttggcttgtaccatgtcaatggctgcattatagtagttcattgtataactgaaagaaatgatttcttcataagtgacattaaatatgaacattcatccaattgaatttacaaaatctttccaaaattataagggagaaaaatcgggttacttccatctttaaaaatctggcacctcttagtaactttcagtatttctaaattgctctaaaattttataataaatagattagggtttgcaatagtcttaatttttaagccaaaggtttctgagaccttaggtttggaggctaaccagcttgggtggtatgtaaaagaatatcttggggttttaaatggtattttaaaaagcttttatgacccatttataaaagggatactcatatgtgctgaattttccggat

SEQ ID NO: 44464 - DNA, 137 bp, Homo sapiens
acgagatccgccgtcactggggcgggcaacgtcctggttctaagtctgtggctcgtatcgccaagctcggaaaggcaaaggctaaagaacttgccactaaactgggttaaatgtacactgttgagttttctgtacat

SEQ ID NO: 44465 - DNA, 333 bp, Homo sapiens
aacactacgcattgggagattggttaccgacttactacaaagagagaaagaaattgcttggttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacctag

SEQ ID NO: 44466 - DNA, 410 bp, Homo sapiens
gataatcatgttggttttaatagtgttaatttttgtaaaataaaaattaaagggaaactctttaccttataaattgtccataggccacactttaatatcacattataaagggaaggacagtcttcattcctcctggtattgggttgtttgtcattaaagatatattttgaatccatgaaattgctatgctaaacagcctttacatgtatggtctggttaaagtcctttggtccttttggtttaataaaatgggcactgatttttagctcaaaatcatcactggtaatttccagcaccccaaatatggtaaaagattttttttaatcatgaagagaaattagtagcattcttctctccccatattatggggttccccactaacttttttttaagccaaagccaaaaaatta

SEQ ID NO: 44467 - DNA, 540 bp, Homo sapiens
aaagaaggccctgaagctgatttggtcaaatgaaggtgaattcaaggctgaagggaatagcaaattcacctacacagttctggaggatggttgcaccgaaacacactggggaatggagcaaaacagtctttgaatatcgaacacgcaaggctgtgagactacctattgtagatattgcaccctatgacattggtggcctgatcaagaatttggtgtggcgttggcctgtttgctttttataaaccaaactctatctgaaatcccaacaaaaaaaatttaactccatatgtgttcctcttgttctaatcttgcaaccagtgcaagtgaccgacaaaattccagtatttatttccaaaatgtttggaacagtataggttgacaaagaaaaatgatacttctctttttttgctgtccaccaaatacaattcaaatgctttttggtttattttttaccaattccaatttcaaaatgctcaatggggctataataaataaacttcaacactctttatgatacccaaaaaaaaaaaaaaaaaaaaa

SEQ ID NO: 44468 - DNA, 333 bp, Homo sapiens
acactacgcattgggagattggttacttgacttactacaaagagagaaagaaagtgctggggttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggaaatcaaaaataatgatattttggagcaaaagtcattttatatttaatcctattttgtacagtaaaaataaaactttaaaacaggttgattttccaaaataaatatgctaaaacctaa

SEQ ID NO: 44469 - DNA, 358 bp, Homo sapiens
accaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaaac

SEQ ID NO: 44470 - DNA, 469 bp, Homo sapiens
ccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagc

SEQ ID NO: 44471 - DNA, 399 bp, Homo sapiens
cagcaatcaaattatggacccatgaaagggggcagttttggtggaagaagctcgggcagtccctatggtggtggttatggatctggtggtggaagtggtggatatggtagcagaaggttctaaaaacagcggaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatc

SEQ ID NO: 44472 - DNA, 120 bp, Homo sapiens
gcctaaaacattcaaagcactaagttttgaacgagcaagaggaggaaaagaaagccatggggttaaagaaacagctttcaagggcctttctgcagcccttcaggagcgcaaagatagatt

SEQ ID NO: 44473 - DNA, 220 bp, Homo sapiens
tcttcctaaatagtgaagaacacacatgctttcatagttttggaatgtgtggtatgtactctatgattgctgaaataaagtgcttttgaaaatcctacaaagtcactgttgaaaatcgcagaaacaatcatcagcaagagagatttcctgttaccccaacgatatgtagcagtactttggagttaagtattatgtaacaaagggcactgcacttgtacca

SEQ ID NO: 44474 - DNA, 130 bp, Homo sapiens
gacattaattgtttttaaaatatagatttcatttgttattatagaatggtaatgtggttagaggacacgcaagatactgggtcatcagccattaagtatatctatttcaaaattaaaatatttgggaggt

SEQ ID NO: 44475 - DNA, 231 bp, Homo sapiens
ttaccctcacattttccacaccagctgtttctaattctgcaactatacattgcatgaaaacattcaatgactccttgataccatcaggataaagctttaaaaattccattgcacctgagtatggtggctcatgcctataatctcagcactttgggaggccaagtcaaggaggatcgcttgagctcaggagttgagatcaagcctggcaacataagtgagaccctgctcttc

SEQ ID NO: 44476 - DNA, 230 bp, Homo sapiens
aatataaacaaaaaaaaaactgacagaaactgaaatttcaattacaaaaaaaaatggaagaaaaatgcaggggactaataaaaaagaaaacaaagctgaactaattttaaagaaaaggaaaacctgaccttcatccatctgcagcacaatcggctgaaagagggatgctgtttcagctgcttttaaaggtcttaaatcactcgaataccttgacttgagcttcaatcaga

SEQ ID NO: 44477 - DNA, 265 bp, Homo sapiens
tgagtgtggacgagtagccagtgaagataatgattgtcagaatgtgactgactagcagcttcattttgaatgagggtcagctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaaaaaaaaaaaaaaaa

SEQ ID NO: 44478 - DNA, 264 bp, Homo sapiens
gaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctagtcaccaaggcagtgcatgcatgttggggtttcctttaccttttctataagttgtaccaaaacatccacttaagttctttgatttgtaccattccttcaaataaagaaatttggtaccca

SEQ ID NO: 44479 - DNA, 399 bp, Homo sapiens
agatagataggtgtttgtccttttaccatcgtgctacttcccataataaccactttgcatccaggactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacggatggttcacagataattctttttttaaaaaaacccaacctcctagagaagcacaactggcaagagcttggacacacaacttcagctttgcatcacgaggcttggattccaagaaaatcaaagggggacaatttgggtggttacactatgatacttgctaaataaactc

SEQ ID NO: 44480 - DNA, 100 bp, Homo sapiens
acaaaaagcccctttaaacttgggcccgctcgaggtcgtttcgactgggccgagacttccgaaaagaaaatggttttttttgccgaaatcaaccgggtaa

SEQ ID NO: 44481 - DNA, 147 bp, Homo sapiens
aaaaaataaataaaagctagatactggaaacctaactgcaatgtggatgttttacccacatgacttattatgcataaagccaaatttccagtttaagtaattgcctacaataaaaagaaattttgcctgccaaaaaaaaaaaaaaaa

SEQ ID NO: 44482 - DNA, 460 bp, Homo sapiens
aacgctggcgcgatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgttaggccaaagaggacagctctttggcctaggaaaaaaccttgagagagagtaaaaaatttaacacccatagtaggcctaaaagcagccccaattaagaaagcgtcaagctcaacacccacttcctt

SEQ ID NO: 44483 - DNA, 171 bp, Homo sapiens
gaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctacggaaaaaaaaaaaa

SEQ ID NO: 44484 - DNA, 693 bp, Homo sapiens
atgattgtatatctatgaaaaccccatcgtctcagcccaaaatctccttaagctgataagcaacttcagcaaagtctcaggatacaaaatcaatgtaccaaaatcacaagcattcttacacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagccaccaatgcctctcttcacagaattggaaaaaagtactttaaagttcatatggaaccaaaaaagagcctgcatcaccaagtcagtcctaagccaaaagaacaaagctggaggcatcacgctacctgacttcaaactatatactgcaaggctacagtaaccaaaacagcatggtactgataccaaaaacagagatatagatcaatgggacagaacagagccctcagaaataatgccgcatatctacaactatctgatcttgcaaacctgagaaaaacaagcatgggggaaaggttccctatttataaa

SEQ ID NO: 44485 - DNA, 580 bp, Homo sapiens
aagagacatctgggtgtttgggaaaccatctgacgaggcctgactctattccagttagattgacaataattgagcagcaggcatttttcatttctggtcaggaaagcattgtgcctttagcaaacaatcagtgtgcaacagtgatgtggtcatctagccagggaatggctgctccatcccctgcataatatattcctgcttcaaacacctctcagaaaaccagttccgcgagggtttttatatccccacaaagttgttgagagacaatgatgaccctggaagtggggaggaggacttctgagaaacagcaacctctctcctgattggggtagccatgagatttctctagctatatccaacttggcatctgtacatcatctttggaggaacatcttatttgtggaaggaccttgacaagccgtttgagatggaatgtaggccctgatgttatgcttcagtaaaaaaagatggaagcttccctgctataccaaaacatggagcaaaatttgcatttttctcaagaaggagagaaaaggggtagggctccagcaaagtttgtcagaaggaaagctagaaaaga

SEQ ID NO: 44486 - DNA, 465 bp, Homo sapiens
ggggagataatttggtaaaatgattctgaagttcatctcaaagagtaaacaggtaggaataacaaaaagtattttgcaaaagaatagtaatactaagggagaagacttaacttacgagatttttaaatgcttaatgacgattttgccatcaaaacagcatatacatcaaggtaaatttcaaaatatatcccatataggcccactgtcctttgtcttaaattcttggggttacatatgtttgtgaatttaaaatttgaatttcagaaaggtaatttggttatatcctaaatattactgaatacttcatagacctcagaacccagtggggtcaggaccagtactacataaacaaacatattgatatttctgtaatgaaactcagtaggacacataaaaactacaaacagcctccaactgattcaagtcatattttgttcccaagtgaacgttggcacgaaactcatg

SEQ ID NO: 44487 - DNA, 673 bp, Homo sapiens
ggcccacagagatacacaatggattcacctgaatggaccaggttgttgaagtggatctcttgaactgtttaagccaagctatttattctcttgactcctgtgataaataccaagcagcaaaaacatttaaactttgctgactccatttctgtattccttttcctctctactaattgtgtgtctggtttgtgcaatagaataatttattccaccttggtgacaacagtgattagaaaatggattttatggtgtgactttctgatgatctacatcagataggtaatagaaatatattatctgatgaatgagaaataagggaatcttgtgtttaagtcttttctttttgtctttatcttttgtctctatgtgtgctcaaatcaattaagaatattttgtccacagaatgtgaaaacaattctgagagacctgaatgagtgagtttttgtgtttctgtgtttactttcaacctttgcctgagattgtgaaactaaagctatgtatgctctctccatatcagtgcatctgtgtgtccatgtgcttgtaattgggaaagggcttgacctctcaggatacgactattgacgtacctaattctggcaggtttaataaattgaatttatcactctaaatcaaaagaccctgttttgatggtgcctactgaccctcaagctta

SEQ ID NO: 44488 - DNA, 471 bp, Homo sapiens
gtaggcccatactgtgtggtataacaggcttaactaaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttacaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaac

SEQ ID NO: 44489 - DNA, 226 bp, Homo sapiens
gagaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaagacatattaaacttgaagcca

SEQ ID NO: 44490 - DNA, 640 bp, Homo sapiens
ggatgatggcctactaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccagtaagttgttagaaacctttataaataactggagttgagaattttaagttgtaactctgtataaaaagagctggcagttctttaagaacaggtattatttactaaaggtgaattaccatggcaaagctgttttgtgttcatagagttaattttattggtactttcatttctataatgtgacgctgggtatatagaaatgtagatcaacatttaaaaaatcctaagtgaaaattaaaagctgtgacattttcttaagtcagaggagatttggtttgtttcctagtagcaaaaagaggcagaccttccaaggaggtagaccccttcctccggtagatcacaaagtaaaaaaggtacagggtgttagggtaattgtgaattcctgggaatgaggagaaagcagaaatataaaccagttgggtcaattgatttaggcaaaacctaaggccgtgtaatggaagtaagtgaaac

SEQ ID NO: 44491 - DNA, 600 bp, Homo sapiens
gctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtacagcactgattgaccacagttgccaatctaaaagcacaaagacagaagtaaagctttatgctaattttatttcaatatgatagaaaatttatcttgggtatgtccttttttagataactccagcaggaaactgtaactgctatgtctttaggaaaatgtagaaagaaagaacattattattccttaattcctacaaggtactccgaaaaccttaagtgaaaaagattctatctttttaacctagcgcatttatgggaaaaatattaactatcctgaatattttataattttgtagggaaaatatgcatctattttttctgacttcctttaaaaaagtaaataaaagttattttgta

SEQ ID NO: 44492 - DNA, 540 bp, Homo sapiens
atatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcgatatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagct

SEQ ID NO: 44493 - DNA, 463 bp, Homo sapiens
ggcattgaggcagccagcgcaggggcttctgctgagggggcaggcggagcttgaggaaaccgcagataagtttttttctctttgaaagatagagattaatacagctacttaaaaaatatagtcaataggttagtaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattacaataatttgaaggcgatcttttaaaaagagattaaacc

SEQ ID NO: 44494 - DNA, 518 bp, Homo sapiens
ctgcctctggccctgagagctgctggacccatcacagagtcttcaggcttcctggcctattatgagatctgccagttcctgaaaggagccaagatcacgaggctccaggatcagcaggttccctacccagtcaaggggaaccagtgggtgggctatgacgatgtgacgagtctggagaccaaggttcagttcttaaagaatttaatcctgggaggagccatgatcatggtctattgacatggatgacttcactggcaaatcctgcaaccagggcccttaccctcttgtccaagcagtcacgacaagccttggctccctgtgaaggattaacttacagagaagcaggcaagatgaccttgctgcctggggcctgctctctcccaggaattctcatgtgggattccccttgccaggccggcctttggatctctcttccaagccttttcctgacttcctcttagatcatagattggacctggttttgttttcctgcagctgatgacttgttgccctgaagt

SEQ ID NO: 44495 - DNA, 580 bp, Homo sapiens
caagctgaagcagagagaactggctcatatgcaggctctttctgaggaatggaagaaaagggaccgagaaagagggtcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactggaaaggttaaaaatcaaacagctcgaagaggataaacaccgccttcagcaacagcttaatgatgctgaaaataagtataagattttgggaaaagagttccaacaggtcaagggccagcataacaacaaacccagaaatccgcctcagtctgaaataaatcttctcacccttggaaaaggttgaacttgaaaagaaagttggaatctgcactaagtctaaactgcattacaagccgcagtgggggccagcctttgaaagaaccttgcccagaccttaaaccggagg

SEQ ID NO: 44496 - DNA, 516 bp, Homo sapiens
gtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtactttatttttcaaaacattgtaaaaatagtatctttggtttagtatttggattatatattataatctgaggagtgttttgcttatgtagaatccagatatatttctgttacctaggagatgttacttacatatgtaatactgtatcctgcacgtggaaatattcagaattgtagatagcataactctccccgctcctattcttttgagcctaggtataattttttttttttttttt

SEQ ID NO: 44497 - DNA, 224 bp, Homo sapiens
ggcagatctgtttctcaaattgagatacttgatgtttttgctgggtaggaggagaaacaagagggacagtggccagttcacggagactatagcagtagggttctggggcgatgttgcggggagcagcatgatttatcacaacccttctgtacccagagagtccccagtgctgttttcttatccttcattagtccctcttcttgttcctaaaaaaaaaaaaaaaa

SEQ ID NO: 44498 - DNA, 522 bp, Homo sapiens
tgaatgcctgtgtgcgtagcagtctcgagaagccgcgtagcgcttgcagcaaggcatggaccaactgactgaaagggcacattgcaaaattcaaagaagctttttcactatttgacaaagatggtgatggacctataacaacaaaggaattgggaactgtaatgagatctcctgggcagaatcccacagaatcagtgttataggacatgattaatgaagtagatgctgatggtaatggcacaattgacttccctgaatttctgacaatgatggcaagaaaaatgaaagacacagacagtgaggaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtg

SEQ ID NO: 44499 - DNA, 313 bp, Homo sapiens
agctcaagatggattaaagacttaaacctaagacctaaaaccataaaaaccctagaggaaaacctaggcaatatcattcagtacataggcatgggcaaaacttcatgactaaaacaccaaaaacaatggtaacaaatgccaaaattgacaaatgggatctaattaaactaaagagcttctgcacagcaaaagaaactatcatcagagtgaacaggcaatctacagaatgggagaaaatttttgcaatctatccatctgacatagggctaatatccagaatctacaaagaacttaaccaaaaaaaaaaaaaaaa

SEQ ID NO: 44500 - DNA, 144 bp, Homo sapiens
actgataaccaaactggagtcaggtattttgtactttgcagtatttctcttgtataccagtttgtgatgttttctctaaaaacttgaagttcctcaggcctgtaacttctcctggaaaaaaaaaaaaaaaaaaaaaaaaaaaaa

SEQ ID NO: 44501 - DNA, 356 bp, Homo sapiens
acacttggcataactcaattgtgccgcatggtaattatatctctatacaactgtttttttaaacaagaagggtttaaccaaaacagcaagctgactaaacagcacgctgccggggaatgacataaagctctgtggcaaggccctttctgtctgtaaccagcaggatatctgagatacctgtaggataaccaacaaccagctgatcatgtgcatttggggaagtctaaggactctattccctacttgaacctggagctaaagttagtgagaggtaaggtaggcaggtgggaattgcagaagataaaactggctggggttaagtaagcacataattaggaagacatatttttatgagt

SEQ ID NO: 44502 - DNA, 609 bp, Homo sapiens
cagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagaatggcccttgacatttgaga

SEQ ID NO: 44503 - DNA, 167 bp, Homo sapiens
gtgggagcagtgtacaccaactcttcctgtatattgcctttttgctggaaaatgttgtatgttgaataaaattttctataaaaattaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 44504 - DNA, 403 bp, Homo sapiens
gaagaagtacttttgaagactcccattttaagaaccgtgcaaattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttccaaaaaaaaaaaaaaaaaaaaaaaa

SEQ ID NO: 44505 - DNA, 539 bp, Homo sapiens
atttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttaacaaagctttgtattactgtgtggttttgttttttttgttgttgtttatttgattttgatttttttttcttttatgtgacctttgggaaaacacattcagaattatatctcgtttctacttaaatgtagtgcttagggttaattttttgtactgaagtctttattggtgggtgcatgctactgggaacaagttttgtacaaaagcttcaatcagaatcactgtgcattactgagactctgttatcactagccttctgtccctcccgcagaagactgtggattgaacaaaataatatgtattttggattac

SEQ ID NO: 44506 - DNA, 426 bp, Homo sapiens
tatccactattataattggagacttcaacacccctcttttagcaattattagataaagcaggcaaaaaattcatacagatatagttgacctgaacaaccatcaatcaacttgatctaattgacatctatagaatattttattcatcaaaagcagactacacattccactcaagcttatgtaggacattcaccaatatcaaccctattcggggcaataaaacatatcttaacagagttaaaaaaatagaaatcataccaagtatgttcacagtcaacatgggagttaaactagaaatcaataaaggaaaaatggctagaatagtccaaagtatttggtaattaaatagcacactagtaaataacccatggttcaaataagaggtgacaagagaaatttacacaggctttgtactaatcagaccaatg

SEQ ID NO: 44507 - DNA, 429 bp, Homo sapiens
ttcaggcctggtggctaaccacgcgtactccaatatattcaggtttactcacgtcatccagtatgagaatgggcaagtcatgtttcctgaattgcatatgtgtctgggtttcatccagccgacattgaagttgatgtactgaagaatggttagagatgtgaaaaagtggagcattcattctcattatgtagcacgggctggtcttgctaccccgtgtacaagacagactccagccccactcaagaagctggggcgcatggcatgtgcaccaggtgactttgtctttgttttagaagcatgcgtgggatcgagacatgtaagcagcaccatggaggtttggagatgccgcatttggattggctgaattccaaattctgcttgcatgctttttaatattgatatgcttaaacacttacactttatgcacaa

SEQ ID NO: 44508 - DNA, 635 bp, Homo sapiens
ctaaccaggccagtgacagaaatggcttcgaaatacgagtgtgtgaagctgaatgatggtcacttcatgcctgtcctgggatttggcacctatgcgcctgcagaggtaacaataatatttttagtgttgagagttcaaaggagctagagtaagtggaagctgaccaggttgtcaggcttgtgttcccatgttactctgcatgactcccctttaaacgtcagtctttgttctgcaatgccgtcttgtcacagggtcatctactgcttatttgtggcactgttttgtcttctgtttatgtttatttcacagcttgtcagagtctataaaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacggggtggatgaaatctgttgggagagtatcactgttctgatgggcggccttgagcaccacactgtaatactagacccggcctaaagagaattccatgtacaattctcacctctgggaaaattacctgaaataataaatatcctcattttagga

SEQ ID NO: 44509 - DNA, 418 bp, Homo sapiens
aaaccgcagataagtttttttctctttgaaagatagagattaatacagctacttaaaaagtatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgatta

SEQ ID NO: 44510 - DNA, 391 bp, Homo sapiens
attctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 44511 - DNA, 383 bp, Homo sapiens
gggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctaaaaaaaa

SEQ ID NO: 44512 - DNA, 539 bp, Homo sapiens
gcattttatgacatttttataaagtactgtaattctttcattgaggggctaccgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatccgcctcgcgggatgttactaaactcgctaatagtttaaaggttacttacaatagagcaagttggacaattttgtggtgttggggaaatgttagggcaaggcctagaggttcattttaaatcttggtttgtgactttaggggtagttagaaacctttctacttaa

SEQ ID NO: 44513 - DNA, 380 bp, Homo sapiens
ggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaaaaaaa

SEQ ID NO: 44514 - DNA, 362 bp, Homo sapiens
atacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggcaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtc

SEQ ID NO: 44515 - DNA, 725 bp, Homo sapiens
gggcgcaatagatatagtaccgcaagggaaagatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagttacatgaaaacattcccctccgcaaaagcctgcgtcaggttaaaacactggaactggcaatttacaagccaaatatctacaaatcaaccaacaagtcactaattacccctcactggcaaacccaacacaaggcatgctcataaggggaaggggtaaaaaaaaagttaaaagggactcgg

SEQ ID NO: 44516 - DNA, 342 bp, Homo sapiens
tgctgagattatttgctgtcatgtggttgtagagatctaggtgggaactcatgtacagtctagattgatggtttttgttgcctggaaccccaattttgcctggcttgatggatggggccctgggagaggggctccgagttctgggtctccagtctgcatgcaattctgtgtgggggcttcatttaaactgtttctgtcattgccaaaccatttgtggatgtaaatagagaaaaccaacaaggatgtaaataggggaaaaaccaacaaggaaatagaatgttttatggcatttaacaatgctctcttttagaactatttttactagggttatgatgaatttca

SEQ ID NO: 44517 - DNA, 346 bp, Homo sapiens
tatgagagggactaggaaaagtgtgtggtctgtggggcggactctggccatcatgttgacagccttgcacttccacaggcgacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccaa

SEQ ID NO: 44518 - DNA, 505 bp, Homo sapiens
cactattcacatcatgatacacttgctaaataaagctgatcagcatatattcatacctgttgtacacttgggtgaaaagtatggcagtgggagactaagatgtattaacctacctgctgactcatatgttgtaggaaaagctgttcccatgtctaacaggacttgaattcaaagcatgtcaagtggctagtagatctgtggcgatatgagagggatgcagtgcctttccccattcattcctgatggaattgttatactaggttaacatttgtaattttttttctagttgtaatgtgtatgtctggtaaataggtattatattttggccttacaataccgtaacaatgtttgtcattttgaaatacttaatgccaagtaacaatgcatgctttggaaatttggaacgatggttttattctttgagaagcaaatatgtttgcattaaatgctttgattgttcatatcaagaaattgattgaacgttctcaaaccctgtttacggtac

SEQ ID NO: 44519 - DNA, 318 bp, Homo sapiens
agaggccatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcagaaaaaaaaaaaaaa

SEQ ID NO: 44520 - DNA, 431 bp, Homo sapiens
cctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattaagtgtgctcttt

SEQ ID NO: 44521 - DNA, 456 bp, Homo sapiens
taaaccacttgtagaatttttcctccgaatttagccttctgagcaacttaactacatatgagttatgtctgacagttaagaaaataataaaaatatgagaaggcacacttaacttctttgtcagagaaaccatatctgttttgggagaagggctgtcttagggcagtaactcagatgactgataatatatcctgaattcgttcacactcactttatttagaaacatagctttttatatgatatgtgttctgaaatccgattatatcactcactgacgtcctttccaccagagatttaattttacaggactaatataactcatttatataatgattaatatggcttttttaattaaaaaaatcttccttctaaagtgtgccaaggattttgactacattttcaattaatttttagatttattggcagaagagcagggttccatcacccttatgttgg

SEQ ID NO: 44522 - DNA, 348 bp, Homo sapiens
cgcgaggtgctgtggcgctgcgtaaaagtatcaatcagccggttgcttttgtgagaagaattccttggactggggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactga

SEQ ID NO: 44523 - DNA, 470 bp, Homo sapiens
taaagacattcgttaactgttcgggaaaatgggtattctcattttggaggtttagtccccaactagcggcacaaaggtataagaagcataaaatatgtagacgatcatagtagtggttattggttaatatggtatgacgattctctggagattgtgtcaccaagatcttcaaagcttaattgcttgactaacagtactaatgtttgaatgaaagataaaaatgtaaactttcgatactaaggcacaaaattatcctatgtctttgtgttatttgaactcacaaaacatatttgagttcatcatttgaattcacaaaaatcaagtagccatgagtccttcacttactaaaagtagtgaattaaaaagaaaaccttgcggccaggtgcggtggctcacgcctgtaatcccagcacttcgggaggccgaggtgggcggatcacgaggtcagggagttcgagaccagcctggcc

SEQ ID NO: 44524 - DNA, 120 bp, Homo sapiens
ggcggagtagtcctcatggccgccccgccggagcccggtgagcccgaggagaggaagtcccttaagctcctaggatttttagatgttgaaaaaaaaacaaaaaaaaaaaaaaaaaaacct

SEQ ID NO: 44525 - DNA, 456 bp, Homo sapiens
gggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatttt

SEQ ID NO: 44526 - DNA, 707 bp, Homo sapiens
gctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggtcgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcaacaggctgatgaataagatctaagagttacctggctacaagaaagaagatgccagatgacacttaagacctaccttgtgatatttaaaatgatgcaataaaaagacctattgatttg

SEQ ID NO: 44527 - DNA, 498 bp, Homo sapiens
tttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttggacttataaatacgaatagttactactctgacttgtaaatgtagctgctaaagtatgaggtatatttaagaagaatagattagtttcattatacctataagaacaagaattcaaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatag

SEQ ID NO: 44528 - DNA, 283 bp, Homo sapiens
atacgcacgtgaggcatccgggcttaactcacatgctcctagtgggtatatgcactaatactacgtttgttgatacagtcttttgaaagagttgatgataagcatttcataaagtatttataaaacactggcatagcttagtgttggagagcagaagagagaattgcttgggattgccaatgatttcttatcatctgctagaggaagactaaataacaacatcatgatgttaaggtagatctaaatgtgttaacaaaaaaaaaaaaaaaaaaaaaaaaaaaaa

SEQ ID NO: 44529 - DNA, 420 bp, Homo sapiens
ctctactaaaaatacaaaaattagctgggcatggtggcacatgcctgtaatcccagctactccggaggctggggcaggagaatcgattgaactgggaagtggagattgcagtgagcggagatcgagccactgcactccagcctgggcaacagagcgagactgtgtctcaaaaacaaacaaaaaagcccaagaagcacatagataacatggtttcactgttgtaacattgtatctgtactttgctacacatggataagtagctataattgtttggacaagcttttgctacaatgtttgctgggattgttcctgtcttctttgtagttttctttcatttttattatgaaatcaaaataattgaaaaatgaaattaaagcacacagaaaatgctcaataaaaaagtcaaaaaaaaaaaaaaaa

SEQ ID NO: 44530 - DNA, 407 bp, Homo sapiens
gatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttgg

SEQ ID NO: 44531 - DNA, 583 bp, Homo sapiens
ggaaccagaaacatgtcataaaagtctggaacatcttttggtcccagaaagtagggaaggagtaaacaatgatgaaaacattgaaataacgcaggatccaccctgaagtagctccctatttccaaattcgggacatttgagcaagaaaataatgaaagtaataggatattctcaatatagtccataaggttgtaagaaagtattgaacaaataaataagtgagggagaaaagaaagctctttcttaacagtaagaatgccaattaagaggaatgatggaaatagaaagtcaccatttggtaaacaccacagtcataatagtttcaggcaagaatcatcaaatggatgctaaatttgtgggtgaaaatataatgataaataggatatttacagagtatcaacatatctcctctcaaaatacttattaattataaaaggaaagtagtaactttacagtggaaaaacctggcagacaccacctaaaacaaatgatcaaagttaacatcaccagtaatgagatatatcaccatcatgtgcctctcatatgattcactgagaaaggcacaaaaagtatttctgtcatg

SEQ ID NO: 44532 - DNA, 287 bp, Homo sapiens
  misc_feature 162, 179: n = A,T,C or G
aacagaaactgtcatctttgctggatcatcttctgcacccaactaagtagttctaagccaaagcagtcaggcaagaacaagaaataaacgggacccacctcagaaaagaggaagtcagattagtccctctttgtagatgacgtgatcttatatagagaaaanccttaagacttctccangaaaagtcttagaacttataaagtaattcagtaaagtttcaagacacaaaatctcaacatgtgaaaatcagtagcatttttatacaccaataatgaactagctgaagt

SEQ ID NO: 44533 - DNA, 369 bp, Homo sapiens
atcacaagaaaagtcagatcattaaactatcaaaagagaattagtaaattgaaagctagagttaaggaagacagtatgcagaatatagcacagaggaaatgagaaaaaatatgacattaaaaagtcatggaaaatagaataacataatactcttctatcagatgtttcaaagaagcaacagaaaaaaataggagaaaagcatgtattagtggctgaatgtttttgagagtaaaagcataaatcatgttgttgaagaagtgtggcatatctaaggcaagataaatgaaaataaatgtacatttaaatatattagaataaaactgtgattcatacatgtaattttaaaaatcaggtcaaaaaaaaaaaaaa

SEQ ID NO: 44534 - DNA, 458 bp, Homo sapiens
attaaaagttctggctaactttggcatccattagagaaaaatccttgtcaccagattcattacaattcaaatcgaagagttgtgaactgttaccccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggacttatacctc

SEQ ID NO: 44535 - DNA, 561 bp, Homo sapiens
gactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagcgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcacctgccgcagcagcaacagcagcaacaacagcagcaacaacagcagcaacagcagcacagtaaagggcatacatttcctgctttcaccaaataaccactgaattgctattttttccttttggccagatagctaggtttctgggttcccccacagtaggtgttttcacataaga

SEQ ID NO: 44536 - DNA, 475 bp, Homo sapiens
gactggtgtcatagggtttgtattgttttgagagtctcattttaaaatcatttgttgcttcacaaacataacctagtagatgtaataataattactaaagcgttaaatcaagagttgattactttttaacttgtttgcatttgagaatgtattttctaaatcaattatttgactataatatttcatttatgtgtcaaatatgatttgaatggggggaattcagttcttagtagtacctaaacataattttaactgtttaaagggaattgacccgtggccgagttatataatttggttggtaagcagcttcttttctttcaccaattgcatgttttcataagatttagagagggttagaacatataactaaatgaaggatagggaaattttcctcatgaaccaagtatcccttaaaaagaaagtccaagttaccagtttaaaactattttgtcatttatatctcccccaccccaag

SEQ ID NO: 44537 - DNA, 454 bp, Homo sapiens
tattccgagaacaatgaattgcaataaccagcttcacacaagcataactgttaaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgtataatttcttttagcagacaagttataagcagatttaattagcatcagaagttgatttatattagcagatttgg

SEQ ID NO: 44538 - DNA, 547 bp, Homo sapiens
ggtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcagggatg

SEQ ID NO: 44539 - DNA, 604 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcagtgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgggaagattaattggggagtggtaggatgaaacaatttgggagaaga

SEQ ID NO: 44540 - DNA, 249 bp, Homo sapiens
tgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaaaaaaaaaaaaaaaaaaaaaaaa

SEQ ID NO: 44541 - DNA, 564 bp, Homo sapiens
gacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaagggagaaaaaaagactgtcatttccttaaaagtttgtgtaacatcctcctctggataacttgactgtaatttaacatctttttcttttgcacatcttcctgagttgaatgtccacgtgg

SEQ ID NO: 44542 - DNA, 508 bp, Homo sapiens
ggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttttgaaaaa

SEQ ID NO: 44543 - DNA, 393 bp, Homo sapiens
atagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaaaaaaaa

SEQ ID NO: 44544 - DNA, 401 bp, Homo sapiens
tggcgcttctgtaaatattgaatgcatgagtcaggaaactgtacacatatgactatcgctccaccaactttttgttatttccctaagcttgttcaggtatggagatgtgtgtctgcacttttgtacagtggccttgcccgcagggagcttgcttatcatcttttagggaagatacactcatcagccaagtaagtgtatgtaacacaaagtgatgtacgtaacaaaagagtcaagagtgccgtgggatttacagcaagggaacttcatctgagcttgagaagctgggagtaagaggtttcatcggaaagtgattgcccacagaagtaggggtgttcgtcatgtgcaaagggcctgtggcaagtaaaagaaaccctgtgtggccagagagtaagaatagggga

SEQ ID NO: 44545 - DNA, 312 bp, Homo sapiens
catggtcactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcactcctaaaaaaaaaaaaaaaaaaaa

SEQ ID NO: 44546 - DNA, 525 bp, Homo sapiens
gtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaacgctttttgttttatttttttaccaattccaatttcaaaatgtctcaatggtgctataataaataaacttcaacactc

SEQ ID NO: 44547 - DNA, 546 bp, Homo sapiens
atcttgctcctcagtactaacatggactaatctgtgggagcagtttattccagtatcacccagggtgcagccacaccaggactgtgttgaagggtgtttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgatgatgaggacaactctctttttccaacaagagagccaagaagccatttttttccatttgatctgtttccaaggtgtccatttggatgtcagtgcattcacgaggttgtacattgctcagaattagggttggcct

SEQ ID NO: 44548 - DNA, 330 bp, Homo sapiens
atttacagtactttaatacttgtataaactatgcagaaatttttaataaagtgtaatatattttataacgctaataagactgaatgggtaaaggtttttagcacgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatatt

SEQ ID NO: 44549 - DNA, 393 bp, Homo sapiens
aatatctgtaatgcctttaaaaacacagttaaaatataacagtgctgtagaacccccgaagccctgagatcttcaacagctgtaactctgtccaagattcagggcaataaaatttaattatttattaaatggacaatttcattgtgcagggccccagtctcttcctcaccaagtcctcaggatggaagcacagacacctatataaaatcatattgccatatttttctcactttattaaaaaatttttttttgctgaaggtttttatatacccattagatattcataactgcttcacaatcatagttttgaatctttgtttggctcattggaaagatttcacctgcacagaaactaagtagaaaataaaaaaacttgtattttgtagtctagac

SEQ ID NO: 44550 - DNA, 403 bp, Homo sapiens
ttcttaaagaatgtcttcactgtgacgagccatggggagcttattgtgccatggtaacaactttggcttgtcctccgagtgaggtgggaagccactggtggattattggcagaggactgatacaactgtttctaagagattgctctggctactctggcaagattggcagacagacatgcaccgataaaaggaaaagcagttacaaatctattctaatagttcaggcaagggataatcgtgacttgcactagcctgacgattgatgcagttcaagaaaaatggtgggattctggacatgtcacagttaagagttgaaaggatttgttgatggattggatgtggagagagggcagggtgtggagattagctctaagattagaagtgggcatcataagatatccat

SEQ ID NO: 44551 - DNA, 225 bp, Homo sapiens
aaacaaaaaaaacaaaacagggctaagagagggtctgtgtgactgactcctaatgaaataatttaaatctctgaatctagccatgcctgacatcacctaatactgttttatttttttaaaccactatgcaatcaagatattctatattttgcttaagccattgtgggtggtgcttctcacaataacaacaaaaggacataaactttataaaaaaaaaaaaaaaaa

SEQ ID NO: 44552 - DNA, 471 bp, Homo sapiens
atcatgatgcatataaactctataatgtataattgtgtttcatttatttaatgtatgagaacatattgaaacacaaaaccatgcattagccaaaaaattggaatacaggtagtgttcagatcagcaaaacattcagtctggtaaatgcctgcctggcgctatgatatcattctcaatgcaggttttatggaaaaactaaaagaatatgttgttagatgatgttggttttgaaaaaaaaaaagacattaacatacacattagttagcccagttaattgcattctactaatatagttgcacattagcaataattttgctgtctcgggtctttattttgtggcttcaactaactggaccatgtggactgtaaaggtcaaatggaaaaaacgagcagtggcccctcatcctgtaaggtactgctacatcagagtgacctaaaagtctaacactgtgaggaaaactgtgatttgtt

SEQ ID NO: 44553 - DNA, 502 bp, Homo sapiens
gggaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacatttgttctgggtgatttctagaatggtttttgttgagtctctgaacatcctaaatattggtttgttattcttttccagaaagaaaatgaatttgactggtt

SEQ ID NO: 44554 - DNA, 457 bp, Homo sapiens
ttccccacttgaagttttcctttagtttagtgatttgagggggccaaaatactttcacatttccccccttttctttttaaaaatctgttggagaacgcattttacgaagaaaatgagtctctggcctcaggtttcgtctgatctctcatggctaggatggtttattcctagatagataggtcctgagttattaggaaagctcctttttagaaggttgtgaagtctcatgtcctgtgaagagaaaatagggggaggacaacaacaaacaaaagaacaattctggaaaatagatatatgccacattactctgaagtccatacatcagtaggcaggtatgaaagtggcttatgtatgtaaataggtcgctgctattttcttctgaagctcaagttgtttagcttcatttcacagggctttatgaaagcacatcttagtttccagtgactccaaatttggg

SEQ ID NO: 44555 - DNA, 176 bp, Homo sapiens
aatataagtaacagttattaatgaacttctaaatttctaatttctctctctctctctttttttttttttttggggggggaaaaaaggggccaaaaaaatgggggcaattctaaggatttcggaaattttaaaagtctaacttgccttcctggtggctttggaaaaaggagtccccc

SEQ ID NO: 44556 - DNA, 622 bp, Homo sapiens
cagattcaaaacaaggattttcactatgtatagtgggaagctagggtaaaagtggcctcggaggtgtactgagtattattttttcaggaggtcctctctgctagtaggtactgggttccaaaaagtaacttttttgtaaaacacagattggatgttttcccatagtgaattaaagcactacagggggcacgactgcccagaacatgaggtttaccctggattaaaccatttgagtacttcactgaagcacagctctattcccaatggttattcccttgtaactgaaaactagttttcttacatcctgcccttgatcttacccaaaataacttctgttctgtaccagttcccctctactcatacttcctcatattcgtggagtacaaaagagcaatttctgtggactcttattctctcacacacatacagagtggtaagagagtaaacctcagtcatttttccctttctcgtccacaagttgtgctggagtgggagccatgattaaaagaggcttaagtgttttataaataacctataaacaaattataaatacaatcaatttttttccttgcaaccataggcaaacactaaaactgttctcagtaaggtttgctttaaaatt

SEQ ID NO: 44557 - DNA, 730 bp, Homo sapiens
gtctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcaaatgggttgtcaaagcccattcgacaagttaaagccaattgtttaaaagaaacggggctttgccccggtgtttgtgcccccgaatttcccggggagggttctgggataaaggggtgaaacacagggcttgttaaaggtcagtccgggccggggggccccaggggacttggg

SEQ ID NO: 44558 - DNA, 660 bp, Homo sapiens
atctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttgggatttgctccagtatgtgtaccatcctgtaaattcatttgagtagatcatgtttacttcccagtgggagggagcactgaaaacctcttaaagaaaaagcaattggggggtttcccttgaacggccggaacaagacgtgttacttcgagataaccaatcactttataaatttgactgca

SEQ ID NO: 44559 - DNA, 349 bp, Homo sapiens
gaaatggaaagatgaaatgatgcaatgatatgaaatgatgacatgatattaaatgatgaaatgaagtcaaatgatgaaaagatgaaatgaaataagtgaaatgaaatgaattgatgaacaatgaattgagatgaaaagatgcaatgatgaaatgaaatgacgaaaagatgaaataaaatgagatgaaatgaactgatgagatgaagtgaaatgatgaaatgttgagatgaaatgatgaaatgaaatgaaagaatgaaatgaaatgatgaaatgaaatgacgacaagatgaaatacaatgagatgaaatgaaatgatgagatgaagtgaaatgatgaaatgttgagatga

SEQ ID NO: 44560 - DNA, 180 bp, Homo sapiens
tctagcagttgtgctccttggtatttatccacaggagttgaaaacttacatccacaccaaattctgtgcatgcatgtttattcatagctgcctgtcatatattgtccgttcattggaccaaaggcttcggcgataactcactggtgctagtggactgttttggtcaatggtgctggatgg

SEQ ID NO: 44561 - DNA, 352 bp, Homo sapiens
gtgtcattcgagggcggatcccctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaaaaaaaaaaaaaaaaaa

SEQ ID NO: 44562 - DNA, 565 bp, Homo sapiens
gtaggatctctctccctactgctgctacacaagaccctgagactgacctgcaggacgaaaccgtgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctttgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtc

SEQ ID NO: 44563 - DNA, 654 bp, Homo sapiens
aacaaaattcattctaaaactagggaaaaaaaggtttgacttaacggttgtggtttcagtaaaaagagtgtgctaacaattccagtatatcatatttgactgaaagatcttgggtgggacagtgggaagagtgagcaccagaatcacttcttaatactaactctatcatttattcactgcataacacagtagttatcaacatttatgtattgctttctatttgccaggatctattctaaattttactaatttaatcctcactatgaggcaagtgatatcattatccccagtttacagataaggaaaatgaggcccagtgatgtattgctagtaataagtggcagactctgaatttgaacccaggctctagagtccttgtatttaaccattagcagtataccgtctctcatattgggaaagtcacttcagttatcagagcctctgctttctcatctcaaaaataaagtgactggctccagaatgttttattatagacagtttgcctggaaacacagaaagaatcaagtggcagggagcagtgaattaccatattctcagcgatctttctcaagtcattgtcttaaaatttgtttaaggatctctagggtttgcagaaactagcaagagtatagttatatgcatacttacgcaaaa

SEQ ID NO: 44564 - DNA, 388 bp, Homo sapiens
cgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaa

SEQ ID NO: 44565 - DNA, 574 bp, Homo sapiens
ggcgcatatcatcgagtcccgccacctctgtgtccagtctcaaggaaagcctccccagcagcagacgtgccaaaggcagagacatgctcagccactcagcaaaatatgccaattgattcttctttcttggttactgggtagaattctgtctaaagatctggaatcctttttctgggtggaaactagatatggatatggttaaagacgtgaatatggattgggggtctggggattcctcccacaaaaagccttttcctagatcctattcataccaagtcacttagttgcaattcttcccaatgaactaagaaatcagaaaaactcacttctcatgaaaaattcctcaccaacaaaattaatgtttatacttcctcaacatccctcctcagtatgccccatttcatcccagaaacaatcatagacacgacacacctgaagcctgggtatatgtgatgtaaaaataaatatttgattctagaaattcaagcaaccaatcaatttcatccctaaatggcatctctaaatttttcctgatggtaaaatttgctgattgaccagttaacagtcaattcaa

SEQ ID NO: 44566 - DNA, 609 bp, Homo sapiens
atagtttaaaatatgtagccacggggaaggggaggcatgtaaatgtcttgaagaggagaaaaagtatgaaagaagatacgatagttacgaataatgtgtatgatgaggacatactttaaaaatgtaattcctctgtacagtaaattacaaatctttagggatttttttgtaataagagaatttatatttgtaatggtctaagaatttttttgtaatgtggtatatagaattttaatttggagcacttataagctggtaagagagactatagcatctgaattatcttggtttatgtttcagcatttcctctagaatttttgctctcaaatatgtgatttaatgaactaaaaacaacactcatcagtcttgggaaatttgaactttgatcaacttaactaaagaaggaagggtagtaagaatttttcaaatacaaatatttgccaattcacagatgataacatttaaggccttcaaaagtaagggtttttccttgtttctccagtcagcttttgtcaactctaatagttttttcataaacattttttatttgtataattgcaacagtttaagaaattatcacaacctatttagaaaacatttaaaatgttc

SEQ ID NO: 44567 - DNA, 202 bp, Homo sapiens
ctcgtgtcctaggccctggtactgcactatccctatggtttctccacactctgtccccagttttgtaaatagtccctttattaagcaaacctcaatttgcaaggtttgtttgtaataatgtatttcttgcttggcgcctcctaggtaataatacggaaataaacaaatcagagattaagacaatttaataaaaaaaaaaaaa

SEQ ID NO: 44568 - DNA, 185 bp, Homo sapiens
accgtctttttgctaggacttaaactgacttgagtgtttcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaa

SEQ ID NO: 44569 - DNA, 203 bp, Homo sapiens
tttggattttacatattcaactgcggtgaaatcttacctgccgcaacagaaattgtttttatttcaggtaaaataagggatcaatttcaaaccctgcttatgatatgaaaatattaaaacctagtctattgtagttttattcagactggtttctgttttttggttattaaaatggtttcctattttgcttattaaaaaaaaaa

SEQ ID NO: 44570 - DNA, 275 bp, Homo sapiens
acagcattggaaaagacatagaaaaggcttgcaatctatttatcctctccatgatgtcttcgttagaaaaggaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagtcagacttcaaatagtggcaaataaaaagtgctatttgtaaaaaaaaaaa

SEQ ID NO: 44571 - DNA, 223 bp, Homo sapiens
caagagatcgagaacatcctgccattgggcggaaaccccgacacgactaagaatagaaaaactagccgggtaggggaggcgcacacctgtagtcccagctactcagggagcctgaggcaggagaattgcttgaatctgggaggcggagattgcagtgagccaagatcgcgccactgcactccagcctgccaatagagcgagactccatctccaaaaaaaaaaa

SEQ ID NO: 44572 - DNA, 452 bp, Homo sapiens
gacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcaaaaaaaaaaaaaaaaaaaaaaaaaaaaaaaaaaaaaa

SEQ ID NO: 44573 - DNA, 427 bp, Homo sapiens
gaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatga

SEQ ID NO: 44574 - DNA, 243 bp, Homo sapiens
gagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatacttta

SEQ ID NO: 44575 - DNA, 524 bp, Homo sapiens
acggcagcacatgaagggaagactacagtctagtatccttcatgaacttagatgcaaaagttctcaacaaaatattagcaaattgaatctaggtatttataaaaagaagtatacaccatgactaagggggatttttttttccagtacaaaagtttgttttaatatttaaaacttaatcagtgtatttcatcacatcaacatatatatataacagaaatattgtataaccatacaattggcacagaaaaagcatttgacaaatccaacacccattcatgacagaaacttacagcccactagaaataaaaacttcccacttcatagagaacatctgcaaaacatttacagataacttcatacttaacagcaaaagactatgctttaaccataacattgggatgaagacgagaatgtccactctcaccactcttattcaacacagcactgaaaatacaagccaaagcaacaggcaaaaaatgattaaaagcatacagattgcttgtagatttcatgtacacgcacaa

SEQ ID NO: 44576 - DNA, 600 bp, Homo sapiens
acagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaa

SEQ ID NO: 44577 - DNA, 360 bp, Homo sapiens
ccaatgttttcattatttaatcttgcaaaaatgggtctgggggcttggatgagaaatgctggcagttttattttttttatgttgttatccttggatgacaaaaaattcagaaaatgatctctgtagatattctgttttattttggcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggcacattttttatgtcagaaaaacacacacacacacacacacacacacacacacacacacacacagag

SEQ ID NO: 44578 - DNA, 530 bp, Homo sapiens
tagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgctctctgtttctattctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggt

SEQ ID NO: 44579 - DNA, 615 bp, Homo sapiens
ctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaaagcctcatttgaatgtgtgaattcagtacaggctatgtaaaa

SEQ ID NO: 44580 - DNA, 618 bp, Homo sapiens
ggggaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcgtaaagttgttttcaatgcaacgcttgttaaataaatattgtgaactattttgtaaatgaaatgtattatgttgaaagctgtcagttcaaaaataagcttttttg

SEQ ID NO: 44581 - DNA, 517 bp, Homo sapiens
atcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttgg

SEQ ID NO: 44582 - DNA, 655 bp, Homo sapiens
aagggagtggctgttttgagttgtcctttctttgcagaaaggagaaaatgtgattgtgtttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaccatctaggaattctctagatatactcagcctaacccagtggcttaacacaaggagatgggctttgatctttttttcttgtggcatcttccagcaagttagaagtctcatgggataagaactgcagttcccctggttcaatagctggaaca

SEQ ID NO: 44583 - DNA, 444 bp, Homo sapiens
gggaagatatgggtgtttttctttattattacttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaataagggatcaatttcaaaccctgcttatgatatgaaaatattaaaacctagtctattgtagttttattcagactggtttctgttttttggttattaaaatggtttcctattttgctta

SEQ ID NO: 44584 - DNA, 495 bp, Homo sapiens
tgttttagtgctaagtagagtgacaggagtttgcatgctggttgtccaatcaaaaatgaattctcaaaacagtccctcacattttattaattggaaaatcaaaaccagtatctactgggacagcaccaactaaactttctggtggaggttatctttgtagagtttgtatttacttccagatcttttctaatgaaatggctctttcacagtcatttatttgccattgactgttgttccctggcaattaattaagaagagggggatagagttcacttctattaggttccctgtccctaccccattccaaagttaaaatctttgatagttggctgtttgtgaattgcagtacatgcctctaatccacaaaaattatttttttggcaggaaagaaaagccccttttttatgaaagattttttttccctaaatatgcatggagatattttgttgtgatttctcaagaactgaatgagagtcccaaattaaaataatttgg

SEQ ID NO: 44585 - DNA, 350 bp, Homo sapiens
  misc_feature 350: n = A,T,C or G
tttgcttttttgcccctctttccaaagataggatctcaaaaaatggtaactaatttaagcccggctaaatgtccagatgcagcacctgggaaaaatgaagttcagaagttcagaatttggaagtgcttaagctagaagaatcttcttgctgtggttgcatgtctggttctggaagctagtaacttctttcaggcaggcattgttccattagaacagatggcctgaagtgtggctgtgccagagagcagagaccgagtgtgaacttgtccaggaagttgaaacacttctcagaatatcttcgggctcctggtaatagccgtgccattgcaactagaactttctgggttggn

SEQ ID NO: 44586 - DNA, 533 bp, Homo sapiens
gagcatatgcaactcgctactgaaaaagtgacttccgttgcataccaaagccgactacactgaacagtaccttcctttctagaaacaattttagatcggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttagggcatatttatactgctgaaggatgagtgttaa

SEQ ID NO: 44587 - DNA, 460 bp, Homo sapiens
gggagtttcctgagggttttctacagaaatgagggctgcacattgccatgttctgcttcgaagcatccaccaccgctcagtattttaaatgaagtgattctaagatttggtttgggatcaataagaaagcatatgcagccaaccaagatgcaaatgttttgaaatgacatgaccacaaattttaagtaggaaagtcacccaaacacttctgctttcacttaagtgtctggcccgcaatactgtaggaacacgcatgatcttgttaccgtgacgattttcactatccacagtacgcactttttccaaatgaccctactaactgcctataaatatctttcacgcacctgcttaccagcaattttcctcactatttttatacggaaaaaattgccctgaaaacacttagtatgcagttgataagaggaatttggtacaattatggtgggtgatactttttata

SEQ ID NO: 44588 - DNA, 593 bp, Homo sapiens
catactaccgagttatacccaactgaaatgcatgcacatgtgtagcaagagacagacatgagaatgttcatggtagtattatttacaaaaacaaaatgagcaaaataacccaaatgcccatcaacagtagaaaggagaattgaattatgttttatttcaataattcagatatttaaatgaataaactacagccactcataagcatatagatgaatttctcaagtacaagattgactaaaagaagctagatacaaaagaacacaacatatgattttacccacataaagtgcaaaaacagtgcaaaaactaaaccatggtgtttaatgcatgtttaggtggcaaaactataaaggaagtaaggagttaatttcctaaagtcgaggatagtaattacactggatgggaaggacaggtaaaaagttggaaggggcgcatgtggtttttggagtgctggcaatgttctatttattcacttgggtggtggttgcctaggtatgttcactttgtaataattaatcgtgctgcatatttttggtttgtgaactctgtgtgttttatttcataatgaaaagattaaaaataaacctattgct

SEQ ID NO: 44589 - DNA, 451 bp, Homo sapiens
cagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaataaacttgctctctgggaaaaaaaaaaaaaa

SEQ ID NO: 44590 - DNA, 306 bp, Homo sapiens
actcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgaaaaaaaaaaaaaaaaaaaaaaaaaa

SEQ ID NO: 44591 - DNA, 312 bp, Homo sapiens
tggaaaacgctttggtagatttggccaggagctttcttttatgtaaattggataaatacacacaccatacactatccacagatatagccaagtagatttgggtagaggatactatttccagagtagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaaaaaaaaaaaaaaaaaaaaaaaaa

SEQ ID NO: 44592 - DNA, 402 bp, Homo sapiens
aacatttgtaatttttttctagttgtaatgtgtatgtctggtacataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctcctgaaaaaaaaaaaaaaaaaaaa

SEQ ID NO: 44593 - DNA, 312 bp, Homo sapiens
taatggacttggatgagtcaagaggtatattgtaagcttcagaccaaccactaagaaaataactcaagaagtagagttaaagatattctaaatgttcttatcacaaaaaagataagtatgtgaggtgatgagtatgttaacttgattgaatcactttacaatgtattcatatatcaaagcatcacatcatacactgtaaatatatataatttttattggtaaattctactttagtaaagctgggaaaaaagaaatgttaaaaattattaaggaaattaaaatgtacaagaaaaaaaaaaaaaaaaaaaaaaa

SEQ ID NO: 44594 - DNA, 405 bp, Homo sapiens
catttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaaactaatcgtcccaacaattatattactaccactgacatgactttccaaaaaacacataatttgaatcaacacaaccacccacagcctaattattagcatcatccctctactattttttaaaaaaaaaaaaaaaaaaa

SEQ ID NO: 44595 - DNA, 251 bp, Homo sapiens
catggttgttgtatgtaagagatttggttcaagatcactcttgagtaaagattaaaatagggctaccatcttacactgctatttcataatgaaaaactactgtcagtattttaatatggttacatttagccaaagttgagggaaagagcttataaaatttaacttcttcataattttagtaatttcctagaggttctgggttttctgaaagtaaaacaatttatgcgaaaaaaaaaaaaaaaaaaaaaaaa

SEQ ID NO: 44596 - DNA, 486 bp, Homo sapiens
agttctaacctcattctgtattgcaagggaaggagcttgtcatatagtcacttgtgttggacccttgaatggctcaactcactgtcctcgtacagtgatcacttcaaagaagcacgtgtttcactgaatacaaccaggggcccatctatctcatgcctctagctcttcatcctcctcccttgaaaattaagatgctctacaaactgttttgaggctgcatctggatttagtaaagagtgttgtcatcaattttcagcttctaccttaggtgtaggagggaactgaggcagcaagcaagtatttgctcactgtctgcatctttccagtatagagaatgcatcagagaaatgcctcaacatgtgtggcactgtgtatataatttccaacactgcaaaatggaacaagcacaaaactttgaagggacggtctatgtgatgaaaagttggaacggcttccaagagctgaaatacactgttgtcagtgttt

SEQ ID NO: 44597 - DNA, 513 bp, Homo sapiens
tggggaaatggaagggtttggaggcagaggtgaaaacagggttggaaggatttcctgaattagaagacaaacgttagcatacccagtaaggaaaatgagtgcagggccaggggaacccgtgaggatcactctcaaatgagattaaaaacaaggaagcagagaatggtcagagaatgggattcagattggggaacttgtggggatgagagtgaccaggttgaactgggaagtggaaaaaggagtttgagcactgcacctagaagcctgcccacgattcctaggaagggctgcagacaccctggaaccctggggagtactgcaaactctcctggattggcctgattttttggggggaaagctgcctggggacaactttccttctggggggtggcaggagtcttctgcagagaaggcgctatcttccctcctctgggatggccgctccaaccattgactcttattacaaaagaaaaaaaaatattaacgtcctagccaaaaaaaaaaaaaaaaaaa

SEQ ID NO: 44598 - DNA, 429 bp, Homo sapiens
cagaagtttctagacaaagccaaagccaaaaagttttcagctttcagaatatccaagggactgagtgaaaagatgtttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctctatgaaacacacaacgtgaaaaataggaacaggaacaaaaagaagaccaatgactcagagggacagaaacacaaacgcaaaaaaattcagacaaaagcagtaatgtttaaaaggttttattaaattatacaaaaacaggcaaaaaaaaaaaaaaaaa

SEQ ID NO: 44599 - DNA, 430 bp, Homo sapiens
gaggaaagccgtgcgttgcgttccaaggcatctttttagcccgcggagtatacaccatgagcaaagggaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgtcagcagagaacccatgtctctctccatagggctgttttactatgatgtaaaaataggcatgacattttcatattagacttttggtaaataaactttgtaatagtcaaaaaaaaaaaaaaaaaaaaaaaaaaaa

SEQ ID NO: 44600 - DNA, 550 bp, Homo sapiens
  misc_feature 533, 542, 549: n = A,T,C or G
aagctgcatataaaccacaacaacctgacagagtctgtggtcccacttcccaaatctctggaggatctgcaggttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggctccctgctctcttctaactctctactttagacaacaataagatcagcaccatccctgatgagatttcaagcgtttaatgcattggagtatctggcgttatctcacaacgaatggtggataggggaatacctggaaatcttcaaggggcatccctggtggaactggtctggctatacaagctaaaacataccactggcatggaaacctggaactttaccggagggcaacacttgagaggtggcataaagagcttcggaagacctgggccttttcccacccaaganaagctttgnggtgggng

SEQ ID NO: 44601 - DNA, 560 bp, Homo sapiens
gataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacctgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatggagacataaacccagttgccatctgcgtgacaataaaacaattaatgctaacactttttta

SEQ ID NO: 44602 - DNA, 133 bp, Homo sapiens
caggggcatcctaacctcagaaactgaaataaagcctttgaaaaaaaaatctgtaaaacatcaacccccaatcagaagatggcaaatggggaataaaaatagcaggtaacacgtccaaaaaaaaaaaaaaaaa

SEQ ID NO: 44603 - DNA, 595 bp, Homo sapiens
atagacacggtccactaacaggaatttttctaaaaatgaggaaggaagtagcattagcagtaaagacccacaggccatgacctttttgatcactctgaggacaatatttaaatgacaggaaggtatattaatgtaacaagcattcatttaaggaatagaccattttctctgacctcttcttcaggaaagctttcacactggtatttgtgatctcaccattatgacatccatccccctagctcaccacatagcacatagaatgatatttttgatttgtaagaggccatccaggtactaaggacccaaggcatacagattcacaaaattaactaatctttttgcctcagaataccaaaacaacaaaattataaagctgtatttggacaactaaaaaacaccaaactatctcattgcaatttgtattttagcagatttcagcaactatcctaaacaatgttattgtgttccatttaactgggataaatgttttgtaaaatacaaccatagaaggctctttgttacaaatgattgcaagaatactgcttgttgcagataattaggtgcaaataagtcaaaaaaaaaaaaaaaaaaaaaa

SEQ ID NO: 44604 - DNA, 422 bp, Homo sapiens
aaattttattgtgataaatattattagtcattgtatatttatgctaagatggactattcatatgtaaattagtcaaaagctgaagaaaatgaggagttaaatcaatgaaagcatttcagagttgatttatatgatattcaaaagtagtaacttatttatcaaagactatgagtctaaaagcacatgtaaattcccttccgttaatgtatctctttcctacttccccatccacctctaaaaaactccgtagtttctagactgtgacctttgctgagacttaatattctaaatcaagttattatactaggtttcccagtgctctccttcactctgttgaaactctaagttgatatttaagaacaattcatgcaaactttgaaaaaaagtaccatttccagtctaaaaaaaaaaaaaaaaaaaaa

SEQ ID NO: 44605 - DNA, 527 bp, Homo sapiens
cgggtgtgaagtcttttcagcaacccggtccactactgggagatacagccatccaccttcagatgtgtctacgtgcgctctgccattcatctcggaaactacaagtaattcccaacgaaagccctcatttttataacctggcaaacacctgtaaatgtcagtgcaactaaatgtgttaacagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaat

SEQ ID NO: 44606 - DNA, 621 bp, Homo sapiens
ataattggctagtgaaagagacctttacctcacagtttcagttttattataaattgcccattagtgcattagaaacaaagtgaaaaagtgagaattgtaactattcttttattctatttgttctaatcctgccactgaatttttttcaacttttttttaatatatgaactcagtatgaaagatgttggggaaattgaatacattattggttaagttgtcaggaatagtatgatcttcaaatattcatttttctgacttcaaaactgaacaaagcctcacacgcatttggagttaagctatttcaccttgtatattaaatataattttgcacatctgaaaaatagcaggtaatgtactcacctaaacgatatcattcttttgtgaggcacatattttcttgggagattagagcttagagaataaagattaagtgactactaaaaattaataagaaggcggagtcagaatgaaaaaaaaaggctgagggctgaagtctttgtttatatcagcttatataatcaacaccttctctttatcaaattcttgaagccatgagtaataacaattttattttatgaggaaacgtgatatcccctggaaaactgtatataaattgcacag

SEQ ID NO: 44607 - DNA, 559 bp, Homo sapiens
gaggcattgaggcagccagcgcaggggcttctgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccggaaggtgattaaaagaccttgaaatccatgacgcagggagaattgcgtcatttaaagcctagttaacgcatttactaaacgcagacgaaaatgg

SEQ ID NO: 44608 - DNA, 556 bp, Homo sapiens
agagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatggaatgatcagggaagcagatattgatggtgatggtcaagtaaactatgaagagtttgtacaaatgatgacagcaaagtgaagaccttgtacagaatgtgttaaatttcttgtacaaaaatgcctatttgcc

SEQ ID NO: 44609 - DNA, 312 bp, Homo sapiens
atgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 44610 - DNA, 296 bp, Homo sapiens
gaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaatagta

SEQ ID NO: 44611 - DNA, 236 bp, Homo sapiens
gaaatgcatcaaaattcatacaatatccattaaattggtaaaagtatccattttaaaggattaatctgagggacccacagacacttaacacaatcaaatctcagaaaaaaatcagttatttcattgtgattttgaggctgatcttttatgatcttttagttatcaaactgttaaatacattttaactttcaaattttatgaataaaggagatgaatcctgtaaaaaaaaaaaaaaa

SEQ ID NO: 44612 - DNA, 224 bp, Homo sapiens
tgactcaatatttataaaagagctccacctgggccggggaaggctgggtttgtggtggttttagtgggctagaacattactatctgaataaacaaatgtgctgcttcttcctgtagacttggaatagtcatgtccttgctttccctaacaattgctgacacaagactttgtatttctgcctgtcatctgtctctcaataaatggatcaattccaaaaaaaaaaa

SEQ ID NO: 44613 - DNA, 449 bp, Homo sapiens
gattttcgttggtggtgttcagttgtggcggttgctggtcagtaacagccaagatgctgcggaatctgctgtgctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccata

SEQ ID NO: 44614 - DNA, 160 bp, Homo sapiens
ctgtggaccttttatatgtgccttcactttagctgtttgccttaatctctacagccttgcgctccagggtggttaataaaatgcaacacttggcattcttatgttttaagaaaaacagtattttatttataacaaaatctgaatatttgtaaccctttaa

SEQ ID NO: 44615 - DNA, 550 bp, Homo sapiens
  misc_feature 545: n = A,T,C or G
gtcagtaaagctgcccagtgattgtttctaaagtagtgcttctaccaacatgtccgggggttccagcgccggatttgaccgccacattaccattttttcacccgagggtcggctctaccaagtagaatatgcttttaaggctattaaccagggtggcttacatcagtagctgtcaagagggaaagactgtcagtaattgcacacagaagaaagtacctgacaaattattggattccagcacagtgactcacttattcaagataactgaaaacattggtgtgtgatgaccggaatgacagctgcagcagatcccaggtacagagggcacgctatgaggcagctaactggaaatacaagtatggctatgagatcctggggacatgctgggtaaaagaattgccgatatttctcaggctacacacagaatgctgaaatgaggcctcttgggtggtggatgatttaattgggatagaggaagagcaaggccctaaggatataagggggaacctgcagggtactactggggggttaaaaggcactgcagngggag

SEQ ID NO: 44616 - DNA, 182 bp, Homo sapiens
ataatgacatttgaatatttctttgtttagaaaaagtggtttataagaaagaggaccaggtggattaaaaaccattgaaaattttgagcaaagtaaaatcaaaggcagattaagattatcaatatatttatagtgactaacccaaatgtaaattaatgaaattgttggggaaaaaaaaaaaa

SEQ ID NO: 44617 - DNA, 505 bp, Homo sapiens
gggaaatattttatataccagatggttcacaagtgatggctcatagctagttttttttttcttctaaaaaatgtcaggtttttaaaatcatttaccttattaaaatgaaaagtgccatacttaacttttaaaggaaagacctgacttgctttttctctatttagacggtttttgtactttactaacctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattaggggttttattgctttcttttaagggagacctgttaatggggaaaaaaatacatcaaatcaaatagaa

SEQ ID NO: 44618 - DNA, 529 bp, Homo sapiens
atatcagaggaagaataagtggaggtagagaagaagggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgacttttttcccttagagatactatttactatctcctatcctgataggtggaaggtttactgaattggaaattggttgactattagtttttaactaaaaatgtgcaataacacaat

SEQ ID NO: 44619 - DNA, 564 bp, Homo sapiens
gtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataaaaaaaaa

SEQ ID NO: 44620 - DNA, 500 bp, Homo sapiens
gaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatatcttgtatcgtctttattttgtacaattggggatttagaataaatgaattgcaccctgccatagattacttacgtttgatttttaaatgccaggttttcatttaatactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcacatttgttattgactgatgtgaggtggtggtcttgt

SEQ ID NO: 44621 - DNA, 213 bp, Homo sapiens
atgtaaaagcatttgtcaatgaaagtaataataattccattcatgcatttgttcatgtataaccaataacttacttgtgatgccatagaaagaattcacagcatcaaactgaaaagcagattttaataggtaagaaactagtggcctttaagctgacaatatatttgtttgaatacaaaatattattattttaaaataatcaaattagcagcc

SEQ ID NO: 44622 - DNA, 341 bp, Homo sapiens
tgaggaaactgaggctcagaggcctcaagtgacttccccgaagttgcacagtgagttgttgttagaactacagccaacacccgagtctctgaactcctgagttaaatgcaaatatctgtggaaaccaatttttttaatgtagggtgtgattctactcatgtaaccttattcagctctggaagtcgatatcctaaataaagaaagagaaataaacaactcctacccttcctttgtagtttagcaagaatttgtacctctgacccaaactccaaggacaagttgcttcaagatgcaaaacaaggaagagcatctgaggtctttaaaaaatgttaaccatagta

SEQ ID NO: 44623 - DNA, 366 bp, Homo sapiens
atgcaaaaacagtatacaacagtagaattagagaacctgaggaattaagtgcgagaactcaggaaagaatgagaaaaacaatcaattgagcataatgaagactatcagtaggaggaacacaggaatgaataaacaccacagctaatgtcttaagataaacaggagatgactaaaaggagaattgaaaccaaaatgaataaaaattaattaagtgagagaactcaggaaagaatgagaaaaaaatcaattgaaataatgaagactaaagtaggaggaacacaggaatgaataaacaccacagataatgtcttaagataaacaggagatgactaaaaggagaattgacccataaaaaaaaaaaaaaaa

SEQ ID NO: 44624 - DNA, 303 bp, Homo sapiens
tgtcctacattcaggccgatagactttaattatttattaaatggcaatttcattgtgcagggccccagtctcttcctcaccaagtcctcaggatggaagcacagacacctatataaaatcatattgccatatttttctcactttattaaaaaatttttttttgctgaaggttcttatatacccattagatattcataactgcttcacaatcatagttttgaatctttgttggctcattggaaagatttcacctgcacagaaactaagtagaaaataaaaaaacttgtattttgtagtctagac

SEQ ID NO: 44625 - DNA, 538 bp, Homo sapiens
gcaccttgttacaaattttttaatttccaaaataatctatattaaatgagggtttctgatctgtactttgtgtttagctacctttttatatttaaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtataagatggccaaaggaccg

SEQ ID NO: 44626 - DNA, 268 bp, Homo sapiens
aaaaagaaagaaatttgaaaaaactttctctttgccatttcttcatcttcttttttaactgaaagctgaatccttccatttcttctgcacatctactgtgcttaaattgtgggcaaaagagaaaaagaaggactgatcacagcattgtgcaatacagtttcagtaactccttccctcgctcccccaaaaatttgaatttttttttcaacactcttacacctgttatggaaaatgtcaacctttgtaagaaaaccaaaataaaaattga

SEQ ID NO: 44627 - DNA, 368 bp, Homo sapiens
  misc_feature 344, 349, 350: n = A,T,C or G
ttttcacagggcatgattatcttcctggctgagccaggagaaaattagaacagaggaggtctgggtgtggcttttgaaacaaagcaaggtaaagccttttttttttcaccttgcattggcaaaactacctcttcagtgtttttaacttttgattcaaaagcatcttaccaataaggataaatatcatatacatcggtatgaaaatattgctatgagataataagccacatatgaatgttgtaaacaactttagggtttacatttaacccggaggtgggacctcctttcaggtcaatttacactatgtttcccatttactaagtggggagggggtctcattacanagtgnntcatcgtaaataagtcag

SEQ ID NO: 44628 - DNA, 662 bp, Homo sapiens
atgaaagaggaaggttaaatcttcactcttagtatgtattgatatgaaatcgtgaattttgttttgggccttcataacatcgtcattttgggttatgcgaaatacaaatttaaatctttgtgaaatgaaagaaaagaggaagaaacgctttttaggagttaaggattaaagtaaaaattattttgaaataattacctctttttgtgaccactttaaaggccaggaacatattggagaagcctagttgtatgttacagtgtggtttacacaaagagcataacattcagtacaaataaaaatcttttctgttggaattagttcaggccactaaaatgtggaatagtaccagatccatagctttttgtgcatgtggaacagaacacgttaaaggaaggcctctgattttttttctcttacaggtcatacccagctgctgtgacaccacttaaatgatttaaaagctttagagagacaatataacagtggttaagagtgtaaacattggagcaagaaatgctccagttagaattctagctctgggcaagtttatgtgcctctataagaagggtatctgttgtaatatgaacaataaatgactgtgtgcctaaatatgtaccaggcactgttttagacattggggtggcagcagtgaacaaaacaaa

SEQ ID NO: 44629 - DNA, 245 bp, Homo sapiens
attcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaattgaaacaaaaaaatacaacagataaatgaaacaaaaagctggttctttgaaaagataaataaaattgataagcattagcaagattaatca

SEQ ID NO: 44630 - DNA, 453 bp, Homo sapiens
gaagagtagcatgaggaaggactagattcaaggtttctacaacatgacggaggttgagatgaaccttcttcatggagtaaaaaatgtctttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttacaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgatgaaaagaataggg

SEQ ID NO: 44631 - DNA, 481 bp, Homo sapiens
ggcctggtggctaggtcggttctctcctttccagtcggagacctctgccgcaaatatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatccatgttggagatctctattgtaatctctattggagattacaatgattaaatcaataaataactgaaacttg

SEQ ID NO: 44632 - DNA, 312 bp, Homo sapiens
ctgcgcgacgcttcgcacgctaatttgctgctgcgctatccctccacaaagactacgctagggggggccagaggggctacccccgccccctctcttcttcgctcgccgcgaatcttctccccgcggaaattaaacccccctcgcggcggcacctctccccaccccagggaaacttgggcgggcacctctgccctcgccgcgccaccctcggccgtctggcgccgctccaacccggggcaaattttgccttggctcgcccacccctaggtgtggtcttgaattgtagagtggaccctcctcgtcttggggggg

SEQ ID NO: 44633 - DNA, 227 bp, Homo sapiens
acttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagctttggccattcttgcttagacagtcagcatttgtctcctcctttaactgagtcatcatcttagtccaact

SEQ ID NO: 44634 - DNA, 235 bp, Homo sapiens
cctgtgcctgtcttcagatcttcacagcacagttcctgggaaggtggagccaccagcctctccttgaataactgggagatgaaacaggaagctctatgacacacttgatcgaatatgacagacaccggaaatcacgacttagccccctctcagcacactcttaccctcgttgcccggcgatcacaggcggaatgcagctgaaagatttcctgtggggctatgtttcacaccgccc

SEQ ID NO: 44635 - DNA, 239 bp, Homo sapiens
caattggctttttcccacttcaataatcatttttcagtttgactcatacagtttaacacaatgtgaattttctttcctcagcataacagaggtatagaatggacagggcttggagggaccttagagagtattcaggtctttcaatttacaaggttaggccacttagacttaaaggtgtatggtatttgtgcaaagggatatagctatattaggagcagagcccttactctggacaaata

SEQ ID NO: 44636 - DNA, 240 bp, Homo sapiens
actgacctgcaggacgaaaccatgaagagcctgatcctttcttgccattctgggccggcttagcggtagttaaactttgtgttatgaattcacattggaaggatgggatcttatgaacctaattccctcaattaccagggggaatgccaataacttccttttcccttgggcgggattgaggggttaagtcccagagagagatacccagagacacatcttatagtctgtatcacagagctc

SEQ ID NO: 44637 - DNA, 235 bp, Homo sapiens
atgggggtgaagctggagatatttcggatgataatctacctcactttccctgtggctatgttctggggttccaatcaggccgagttgtttgaggacgatgtcatacaacgcaagaaggagctgttggcaacttagaagcttcaagagatagagagaattcaaagagagagttacggaagcgcgcgcggagagagaagctcccctcgcgacgcgccagacagagactctctctaga

SEQ ID NO: 44638 - DNA, 238 bp, Homo sapiens
agaaggagtcacctgcagtcttttgtctttctaaatacttaggacttaggacttgtgttattgattagtgaggggccaataaggaacatcttggtatttggaaacaagtggccaattttacaatcatcttctggacttaacaaaacttttcatccttaaacagggacaaggaatggatatctctctgctgtgtgcgctctctagagtctctctcttccccaatgagagtgtggggaca

SEQ ID NO: 44639 - DNA, 215 bp, Homo sapiens
aatacaaattttctccttcatcacttaggtgttttaagatgtttaccttaaagtttttcttggggaaagaatgaattaatttctatttcttaaaacaattccctgagccagtaaacagtaggttaatcatttggcttttcaaaactaggggttttaaaaaaaggggcctttatgatattgccgtttatatacaatatacacaggcacacacaaag

SEQ ID NO: 44640 - DNA, 225 bp, Homo sapiens
tcagaatatccaagggactgagtgaaaagatatttgcaaaacctgaagaacaaagaaaaacactggaagaagatgtagatgacagagcaccttccaaaaaggggaagaagccgaaggcacaaaggggagggggacaggggacattcaaataaggttcccgggcgtttccactcaaaagagacggaggcgagcacgtacgccaaaaaccgcgcgccgaaaaagttt

SEQ ID NO: 44641 - DNA, 192 bp, Homo sapiens
caccatagcaaagcctacccctccgagttaaaaaattatggacaagaagttatattgaaattaaatggtggcagacaatgtccaaggaatattgcggggatttgatccctttatgaaccttgtgataaatgaatgtgtggagaaggcgactagtggacaacagaacaatattggaatggtggtaatacgagg

SEQ ID NO: 44642 - DNA, 226 bp, Homo sapiens
aagagatcaaggtccttttcgacaagctgaaggaggctgagactcgggctgagtttgcggagaggtcagtaactaaatttgagaaaagcatttatgacttagaagagaaagtggctcatgccaaagaagaaaaccttagtatgcatcagatgctggatcagactttactggagttaaacaccatgtgaaaacctccttagctgcgaccacattctttcattttgtt

SEQ ID NO: 44643 - DNA, 199 bp, Homo sapiens
ctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaccatcattcatggcagtgattcagtaaaaagtgctgaaaaagaga

SEQ ID NO: 44644 - DNA, 218 bp, Homo sapiens
attaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcactcctataaatagtatgataaatgcacagacaattgcagtaaattctc

SEQ ID NO: 44645 - DNA, 229 bp, Homo sapiens
taaatcatctttccaatccggaggaacaagcatgtctctctgccaagatccatctaaactggagtgatgttagcagacccagcttagagttcttctttctttcttaagccctttgctctggaggaagttctccagcttaagctcaactaacagcttctccaagcatcaccctgggagtttcctaaaggtttcctcataaatgagggctgcacattgcctgttctgcttc

SEQ ID NO: 44646 - DNA, 224 bp, Homo sapiens
atcaataggaaacatattcaaccaaccaaaatgcaaatctttttaaattaatattaccaaaattttaaataagaaaatcacccaaacacttcttctttcacttaaatttcttccccccaatactttaaaaacaaaccattatcttttttactctaatattttaaatatccacattactcactttttccaattaatcctattaattccctataaatatctctctc

SEQ ID NO: 44647 - DNA, 226 bp, Homo sapiens
aagattttgctcatcttttttatgccttttgacattgaatgacctattactgtatgcgcattacttgaattttgaggggcactctaccttggttatgattcagtagaggaaaaagaccacctttcttcaatttacaaattaaatcttctgggggggtcgctatcacaaaaccattgaagaagtattccataataattttttgggaaaaccccacaatgtggtcaga

SEQ ID NO: 44648 - DNA, 152 bp, Homo sapiens
aggtggaggttgcagtgagctgagatcgcaccactgcagtccaacctgggtgacagagcgagacttcgtctaaaaaaaaaaaaaaaaaaaaaaaaaaaaaaaaattggggcccctttggcccaatttcctttttggtttgggaaaatttttt

SEQ ID NO: 44649 - DNA, 112 bp, Homo sapiens
taactaccatggctcccgaagttttgccaaaacctcggatgcgtggccttctggccaggcgtctgcgaaatcatatggctgttagcattcgtgctatccctgggggttgcag

SEQ ID NO: 44650 - DNA, 226 bp, Homo sapiens
taaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagtttcctgcaaaatagtagagaccctgcccattgagga

SEQ ID NO: 44651 - DNA, 461 bp, Homo sapiens
ccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggccttggtgttgcagctcttgcatttgcaggtcgctacgcatttcggatctgtgaaacctctagaacaagttatcacagaaactgcaaagaagatttcaactcctagcttttaatcctactataaaaggagggtttgaacagaaaatgagtaggcgagaagctggtctaattttagggttaagcccctctgcctggcaagcttaagaattggcccccccctaggggggtctgttttttgatccccccctaaagggggggtccctagggggcgccgaadatatttgggggttaatttcttataaacaccccccccctttgtt

SEQ ID NO: 44652 - DNA, 412 bp, Homo sapiens
attgcctgttctcgttcgaagtattcaataccgctcagtattttaaatgaagtggttctaagatttggtttgggatcaataggaaagcatatgcagccaaccaagatgcaaatgtcttgaaatgatatgaccaaaattttaagtaggaaagtcacccaaacacttctgctttcacttaagtgtcttgcccccaatactttaggaacaagcatgatcttgttactctgatattttaaatatccacagtactcactttttccacatgatccccgtgattccctaaagatatctctctctcacctctgatatatcacttttttccccgtagtttttatacggggaaaatagtagtgttacacccggtagtgctgatgatgaagaggaggtttggagtattattggtgggggataa

SEQ ID NO: 44653 - DNA, 321 bp, Homo sapiens
atgcacaactatgtgaagatattaaaaagtcattgaactttacactttaaatgagtgaattgtgcggcatggaaattatatctctatacaactgttttttttaaacaagaaggctttaacctaaacagcatgctgaataaacagcatgctgaaggggaatgacatatagctctgtgtgagaggccctttctgtctgtaacccgcgcagatatctcgagatacccttagggtatctaagaagcagctgatcatgtgcatatagagaagtgtcaaagcctctttttcccacttgaccctcggagctttagggagggagaggta

SEQ ID NO: 44654 - DNA, 200 bp, Homo sapiens
tacagtgggtggcattagtatgcactagctgcaaagtcacagcaccttatggaaataagtatggtttattataataaaccacagtgtaagctgcatctctgtagagttatttactttgcagactgtaaagctgccctatctttttccagcagaatttactcttcccaattcttaattctttttttgaaatatctcaaaat

SEQ ID NO: 44655 - DNA, 311 bp, Homo sapiens
tacctcttttcatgatctttttctttccttcccaagaaactgaggaatgtttaatatgaaaacatacatcggatatgtaaaacacacaacaaaattcttaatgtacacagtaaaaaggtaaatatataagtgtgggtggcatttaggcccacagcttgctggagtttgtgttaagctatgtggaataacttgattttgtataaagctatttaagggtgaggctggaggggcgcagcttcacagagactcggagagaccacagcccacagggcccctcccccaccctcatttagggcatacagggacacgct

SEQ ID NO: 44656 - DNA, 417 bp, Homo sapiens
atggcggttctctggaggctgagtgccgtttgcggtgccctaggaggccgagctctgttgcttcgaactccagtggtcagacctgctcatatctcagcattttttcaggaccgaccttttcccagaatggtgtggagtgcagcacatacacttgtacaccgagccaccattttggctccaaggctgcatattttccactggactagcgagagaggtttccagtgtttttgctcctggggctgcttccggctcgcttatttgaatccttgctcttcgatggactattccccggctgcagcccccacacttcaaggtcactggggcctctgacaagatgttactaactattttcataaagggatgcctctcagaaagctgcccgcccaggagtttttggcacttttagcattaacccct

SEQ ID NO: 44657 - DNA, 309 bp, Homo sapiens
ccagagacccagaatgctttctgtagcctaacctaatgttcaaaaccagggcagacccaagccatggaaagcttgagggaataaaataatattctgctgcggtcaagaataacaatgctaattcctggataaggggaatttaaaatgatgtttaacacactttctgggtcttttaatattgacccaagtttaaaacatgttcatataaaaaggggtatctcgaagagaatttataaaatgtaaactcggggttatttttagagtgagcagagtttatagagtgatctctttgggtttttttttccccac

SEQ ID NO: 44658 - DNA, 300 bp, Homo sapiens
tactcctgtattgagttgtatcgtgtggtgtattttttaaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttctgggcaagcagagaaattaaattgtacctattttgtatatgtgagatgtgttaaataaattgtgaaaaaaatgagatataggcatgtgtgggtgtttcacaaatct

SEQ ID NO: 44659 - DNA, 472 bp, Homo sapiens
caatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtttctttctgctggggaaatcccagtacagatcgtttctcatctctaagtgcctcattgagttcggtgcatctcgcccatgagtctgctgagactcttgacagcccctccggctttggtggttcaacaacagtgacttgctctccaatggtttccagtgatttgttgagagggggtgctctctagcagaaactagctccgggggggtggtctaaataggttgtctaatgact

SEQ ID NO: 44660 - DNA, 222 bp, Homo sapiens
  misc_feature 195: n = A,T,C or G
ccagatcaaacagaaatgactattgaaggcttgcagcccacagtggagtatgtggttagtgtctatgctcagaatccaagcggagagagtcagcctctggttcagactgcagtaaccagtacgtaaccactgcttggtttccattttcaaagtcaaattttgttcttgggtgtctgaaatgcccacgacatgtcnttttgcaattacacataggggaagtga

SEQ ID NO: 44661 - DNA, 216 bp, Homo sapiens
  misc_feature 190: n = A,T,C or G
ccaactgtgtaatttctggtcagtgattccaggttttaaataatttgtaagtgttcagtttctacacaactttatcatccgctaaggatttaaaaatcacattctctgttcagctgttaatgctgggatccatatttagtttataagcttttccctgtttttagttttgttttgggttttttggctcatngaattttatttctgtttgtcgataag

SEQ ID NO: 44662 - DNA, 230 bp, Homo sapiens
cttattgaaatataatgacatctactgcaaaataggactactaaatacatatactttacatgcaaggtacatttcttaaggaattatttctggtaatttttgaggactttattacttgataataggtattggtttaaaattttccaaattattctttaaatagttgttaggtagagattattcagtagagccagtaattcagaataactattggagaaaataataataat

SEQ ID NO: 44663 - DNA, 217 bp, Homo sapiens
ctcatgcagtggtacaaggaccagaagaaactgcaccagaaatgcgcctaccaggatttcagacaaaaatcaggaatcatcaccagccaagactgtgttcagaccacgtgacgtcttccaggcaccaggaagaaatacgaccaacctccgtaacaaatgagagaaacttcacctgactgtgttttgtgcatttggtttatgagtcgttttaaaaacg

SEQ ID NO: 44664 - DNA, 227 bp, Homo sapiens
caatactcccgaattgacctaaagattcaacacaatctctatcaaaattccagctggcttgttgtagaaattgacaggctgatcctaaaattcatatggaaatgcaagagcccccaaaacaactaaaataatcttgaaaaagaacaaatttgaaggactcacactgtaatcaaggccatgtggccccggcatatggatagacacgcagcccagtggaatagaattac

SEQ ID NO: 44665 - DNA, 227 bp, Homo sapiens
ccagacttcgctcgtactcgtgcgcctcgcttcgcttttcctccgaaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccgcaagca

SEQ ID NO: 44666 - DNA, 231 bp, Homo sapiens
  misc_feature 201: n = A,T,C or G
actagttttgttgctggtttcattgaaaagacaggaagcaagacatgcaagcaatgtttgcatacttaaagacattcgttaactgttcgggaaaatgggtattctcattttggagggttagtccccaactaggcggcacaaaggtataagaagcataaaatatgtagacggtcataggtagtcgttattgattaatagtgngtatccccggtgtctctggaggttgtgtcc

SEQ ID NO: 44667 - DNA, 226 bp, Homo sapiens
aatcctttgaatgttccacggaaacactggtggacagattctagtgctgagaagaaacacgtttggtttggagagtccgtggatggtggttttcagtttagctacggcaatcctgaacttcctgaagatgtccttgatgtgcagctggcattccttcgacttctctccagccgagcttcccagaacatcacatatcactgcaaaaatagcattgcatacatgggtc

SEQ ID NO: 44668 - DNA, 228 bp, Homo sapiens
ttgttggatcaggacatcccaatggtgcagccgctattaaaggttcgtttgttcaacgattaaagtcctacgtgatctgagttcagaccggagtaatccaggtcggtttctatctacttcaaattcctccctttacgaaaggacaagggaaataaggcctacttaaaaaagcgccttcccccgtaaatgatatcatctcaacttggttttatacccacacccccccaa

SEQ ID NO: 44669 - DNA, 211 bp, Homo sapiens
ccgtgagaggggtgtgacccagatatgagttttggggtaggagtggggtagaaagtgggaaaagggaaacaggggtggcatttggtgtgggggcgtatcgcgcggggagcatgaggtggggtgtgtgctgggggatgcgagacaggaggcggtggggtgtagagggaagatgggggctgatgtgaattgtgaaggctgggggagtttgggt

SEQ ID NO: 44670 - DNA, 139 bp, Homo sapiens
aattgacactgcattccacagttacaacctcaacctttttgctaaggcaggacccatttttgccacatttcaccttgaattttgaaaaaaagagaggcattgccccattttctctggaaccgttttaggggtaggggtt

SEQ ID NO: 44671 - DNA, 222 bp, Homo sapiens
ttgataacttctgaggcagacatttgtctcgcttttttcatttttgttgtgtcttataaactgactgtttttctttgctttgatactgtgattccaaaataaatctcattccagcaaggttagggtcccgccttatcaaatgtcataattggtgtacccttgagaggttttcaatatataggctttcttatgtaaacccctaggatatgggcgcagggggag

SEQ ID NO: 44672 - DNA, 171 bp, Homo sapiens
tcagatctttctccttgaatatctttcgataaacaacaaggtggtgtgatcttaatatatttgaaaaaaacttcattctcggtgaggcatttaaatgtttacaatttacaacactggaacttggggtttctgtttgtattcttttttaaaaaaccatccttttgggatttc

SEQ ID NO: 44673 - DNA, 211 bp, Homo sapiens
actgtgaatttattccatgcatgtaataaactctgcaagaagtttaacccacataggtttgcggcactgcaaaattgttcatgggtctatgtagcaaatgattccctgcccttgacaaatcatggtatacatattcaagggtttcctatccataagggataatcgggttggggacttccgctctttcctccaataagggcaaattaaaaaa

SEQ ID NO: 44674 - DNA, 231 bp, Homo sapiens
acttaagttcaagaatcagcatgattcttcagaggctcttcaggttctcctctgtcattcggtcagccgtctcagtccatttgcggaggaacattggtgttacagcagttgcatttaataaggaacttaatcctatacagaaactcttttgtggacaagattagagtatacaaaatctatagcgcgcacacattttagaggagccctgtgatatgtagtttcagagtatca

SEQ ID NO: 44675 - DNA, 111 bp, Homo sapiens
aaaacaccctcatgttcatacacctatcccccattcttcttctattcctcaaccccgacatcattaccgggtttttctcttaaaaaaaaaataatatatatacaatctata

SEQ ID NO: 44676 - DNA, 232 bp, Homo sapiens
cctttggagattctgaacacaaactcgagacgagttcagggaagagtactggggaagatttagaggaaagggaagttgaggccctaaaccctgggtaatttctttcaaaaggcctaaggcctaaaatcggaaagggggttaacccgccctgggccctaaaggcacgtccccccagacaaacagagggtggatgggaggttactctcaaacggagggctctttccacacaccc

SEQ ID NO: 44677 - DNA, 152 bp, Homo sapiens
aacatcttttggtcccagaaagtagggaaggagtaaacaatgatgaaaacattgaaataacggagggtccaccctgaaggtaggttcctatttccaaattcgggacatttgagccagaaaataatgaaaggaatagggtattctcaatatag

SEQ ID NO: 44678 - DNA, 154 bp, Homo sapiens
ctaatgatgttgaacttgttgctgagggcaacagcaggttcacttacactgttcttgtagatggctgctctaaaaaggcaaatgaatggggaaagacaatcattgaatacaaaacaaataaggcatcacggctgcccttccgtgatattgcacc

SEQ ID NO: 44679 - DNA, 312 bp, Homo sapiens
agttcaaacctaagcagctggaaggaaccatggccaactgtgagcgtaccttcattgcgatcaaaccagatggggtccagcggggtcttgtggggagagattatcaagcgtttttgagcagaaaggattccgccttgttgggtctgaaattcatggcaagcttccgaagagtcttttcaaggaaacactacggtagacctgaagggcccgtaccattctttagccgggcttgggggaaattacaaagcacttaggggccggtaggtggcatgggggtttgggagggggtttaaaagcgggcaaaacgcgccc

SEQ ID NO: 44680 - DNA, 277 bp, Homo sapiens
agtgaggcatccgggcttaactcacatgctcctagtgggtatatgcactaatactacgtttgttgatacagtcttttgaaagagttgatgataagcatttcataaagtatttataaaacactggcatagcttagtgttcgagagcagaagagagaattgctttggattgccaatgatttcttatcatctgctagaggcagactgaataacaacatcatgatgttaagggagatctaaatgtgtttacacagaaacgaaaaaaaaaaaaaaaaaaaam

SEQ ID NO: 44681 - DNA, 189 bp, Homo sapiens
gaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagattttggcatagggataagctctaggtcttaacaacccaca

SEQ ID NO: 44682 - DNA, 203 bp, Homo sapiens
aaaaaatttaaaaatattgtggtatgacaacatatgtggcactcaaaatgctggtaactgcattactgcagtttttagtgtgccaagtggcagtgcaaaatgatgacagcaccacataagtctactttgcatttgttcaactctgccattctaatgtgaacgcgatcatagacagtccctgaccgaatgagtttgggccatgt

SEQ ID NO: 44683 - DNA, 188 bp, Homo sapiens
tagatggctgctctaaaaagacaaatgaatggggaaagacaatcattgaatacaaaacaaataagccatcacgtctgcccttccttgatactgcacctttggacatcggcggtgctgaccacggacttctttgtcggacattggcccagtctgtttcaaataaatgaactcaatctaaattaaaaaga

SEQ ID NO: 44684 - DNA, 216 bp, Homo sapiens
aatctaaattaaaaaagaaagaaatttgaaaaaactttctctttgccatttcttcttcttcttttttaactgaaagctgaatccttccatttcttctgcacatctacttgcttaaattgtgggcaaagagaaaaggagggttgatcagagcattgtgcatacagttcgatgacctcctaccccggtgccccaaaagttggatttttttttcgacca

SEQ ID NO: 44685 - DNA, 216 bp, Homo sapiens
cctctacttgcaaagggaatttgaaaaagatgagaagccacgtgacaagtcatatcaggatgcagttttagaaggtatttttaagaagaatgaccatgatggtgatggcttcatttctcccaagggaatacaatgtataccaaccacgatgaactatagcatattggtattcgtactttttttttaggctatttacctgaccttatggataaaaca

SEQ ID NO: 44686 - DNA, 277 bp, Homo sapiens
cgataactctatcttgacccttttgtagcaacaatgaaatatcagtcttgcttttgcaagcaaaatagcagagcttctgcccttggggaagcaagagaaatgacaataaccgaaaggacagtaagactgttctgttagaacatcagtgtcgggtttttgttaagaaaggaggtaaacagcaggtggccagacaggcttatttgctaagctaaattgtagagtggattatggggcaagagtgttaaacagatgttggattatgtaatatattacctac

SEQ ID NO: 44687 - DNA, 283 bp, Homo sapiens
aaatagactaaaacatattctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagagaaagc

SEQ ID NO: 44688 - DNA, 222 bp, Homo sapiens
taaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaacc

SEQ ID NO: 44689 - DNA, 425 bp, Homo sapiens
ctctcaaagctagtgaaccagcagcttcttgctgacccacttgttccacctcagctaactataaaagacttctacatgacagacccactgatggtgacaccagaactcagggaatgttagtcaattaacagctgccaagttacccagagaggcagatggtatatctgatcatgtcctacaaaatgtgaaaagggaatactcaaagatgtttgctcaaatatgctagagtttccacacaaaaggctataatggcaaccatatatatttggacatcttctatgtttgcttttactccaggggattctcttatattccatttaaaattttgtgacctgaacggctagtcatcttaaaataccctgggatatcacacgtttgagtatcttgggcaaaagaactcacaacagaaatatgtcagtggagag

SEQ ID NO: 44690 - DNA, 340 bp, Homo sapiens
cgactaccagaaagcgctgctgtacctgtgtggtggagatgactaaaggcccgacacggccctgaggcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaggtgaagtctattatgttagacactttgcctcctgtgtactgtgtaataacagatgagtaaactgaatttgtactt

SEQ ID NO: 44691 - DNA, 422 bp, Homo sapiens
cttctgctgagggggcaggcggacttgaggaaaccgcagataagtttttttctctttgaaagatagagattaatacaactacttaaaaaatataggtcaatagggttactaagggtaattcccttagcgttaagtttttaacgcaaattttaatagcttaagagtttaaagagaaaaaatgaagacttagaagagtagcatgaggaaggaaaagataaaaggtttctaaaacatgacgcaggttgagatgaagcttcttcatggagtaaaaaatgtatttaaaagaaaattgagagaaagggctccagaccccgaattaatcccaatagaagggcaatccttttagattaaatgaagggtgcttaccagcttaagtttagtttaaagttgtgggtgattaaataatttgaggcggatctttt

SEQ ID NO: 44692 - DNA, 159 bp, Homo sapiens
ccaaattatcttgatacattcaaatttgtctggttaaaaaataggtggtagatattgaggccaagaatattgcaaaatacatgaaggttaatgcacttaaaggaggatttttaggaataaggaatttgccaaacctacccgggtaaaactttggggatt

SEQ ID NO: 44693 - DNA, 151 bp, Homo sapiens
aaagctctctgaaatagtgaccttagcgaagaagcacatgtggatgtgaaatttcagttgccaatatgatctgaaaacccagtggatggctgaaggtgttaaatgttctatgatcattaaggatactttgttctttggtaatttgtccttt

SEQ ID NO: 44694 - DNA, 137 bp, Homo sapiens
gctgagagatcctacattcatgagtaggccaaaaaaaagttgcatcccatttaaggaaaccctgtaacttgaaagatagagactaaactgatcaaacagaacagatggaacagaattaatggaacaggggacaactt

SEQ ID NO: 44695 - DNA, 300 bp, Homo sapiens
aataactctgaaacaagagaaaaggtttttaacttagagtagccctaaaatatggatgtgtttatataatcgcttagttttggaactttatctgagtaacagaggacaacttttttttaaccctttttttcaaggtttttggactacatggctctaatatggcatactaaaaaaactacatatgatctaagaagaaactagccttgtggagatatatagatgcttttcattatacacacaaacctccctgaggcacataatggaggcatgaataataaaacatttttttattctcaggaa

SEQ ID NO: 44696 - DNA, 140 bp, Homo sapiens
agaatagctgcccatagcagccatccgtctggataatagcaaaacactctagataagttattttgcactttcttatgtataaagttggtagaaacttatttttgctttgtataatttaaatacaatttggttttggtaaa

SEQ ID NO: 44697 - DNA, 212 bp, Homo sapiens
aaataaggtaattaaggctaaggaaacagcaaatttaccctcacaggttctgaggaatggttcacgaaacaaacctgggaaatgagcaaaacaattctttaaatatcgaacaagcaatgcttttagcactccctattcggaatattccaccctataacattgggggcccctaatcaagaaatttggtgtgcacgtttggcccctcttttcct

SEQ ID NO: 44698 - DNA, 260 bp, Homo sapiens
  misc_feature 229: n = A,T,C or G
aggttgcagtgagccgagatcgcaccattgcactccagtctgggcaacagagttagattccgtctcaaaaaaaagaaagggaaggggaaaggaattggcatttttccccttcccttgtatcaaccccccattgaaaatttttgaccactccaaattcagttgaatatcccaaaccaaaattttttaaggtgtagggttgtgtggctccttttgtaattgggtactgggnggggccctcagggtttttttcttcttccagg

SEQ ID NO: 44699 - DNA, 211 bp, Homo sapiens
aaggttgctgagctatttgaaaaactaaggaaagtagagggtcgagtttcatcagatgaagatttgaagctaacagagcttctcccgatactacatgctcaacattgaagctgctaaggatctcttatacagagcggaccaaagcccctcattgactatgagagactcacacaaagctctttgataggggcccgcgtaaaggggcacagac

SEQ ID NO: 44700 - DNA, 201 bp, Homo sapiens
ttacaatttgttaatttccaataatctatattaagtgagggggtctgatctgtactgtgtgtttagctaacctgttataattaagaaagttaaaaatggaaattacggtcctaccaggctaaaggtttatttggtctcttgtgttaaaagtccacaaatgtactctaaatgtgtgtactctgagtagtcctataaattgca

SEQ ID NO: 44701 - DNA, 248 bp, Homo sapiens
cttaataaattctttaaaggagagaactgaaactaggcctgatagatttgtcttggtcaagtgatgaaaccctcaggtttatccgagttaatgcaattctctctcttggttatatttcaagttgcttcgcgtttttttagtgtttgcacagtgtagacccttttaaagagtgtgcctctagagaattctggcaaagcctcaaagagaatggccttcaccctcacagtaccattttaaattcacatata

SEQ ID NO: 44702 - DNA, 286 bp, Homo sapiens
tctctttgccatttcttcttcttcttttttaactgaaagctgaatcctttccattttcttctggcacatctacttgcttaaattgtggggcaaaagagaaaaaggagggttgatcagaggcattgtgtcaatccagagttcatataactctcctccctgggttccccaaaaaattttgtgatttgtgtggtcaacactctcacacctctgtatggagagtgtcaccctctgtaggagaagcacattaaatagttgtagatatatacaccataaacatttgcggcac

SEQ ID NO: 44703 - DNA, 114 bp, Homo sapiens
atgtaaaaatacacattctaattaaggctttgcaacacaaaagggaaggggggggggggaaaaaaaaaaaaaaaaaaaaaaaaaaaggaaaaaaaaaaaaaataaggagacaaa

SEQ ID NO: 44704 - DNA, 252 bp, Homo sapiens
agactggacattatttgtgccaaccaatgatgctttgagggatgactagtgaagaaaagaaattctgatacggacaaaatgctcttcaaaacatcattctttatcaccgacacccgggggtttcattgggaagggtttggacctgggtttacttacattttgagggcccacacggggggcaagatctttctgggagaggtgtatgatacaccctcgggaatttgtttggtctcaggggtctctcacatcgtg

SEQ ID NO: 44705 - DNA, 216 bp, Homo sapiens
tgccattttgtttgttcagtggagactccctggccaacagaatccttcttgatagtttgcaggcaaacaaatgtaattttgccgattccaaggcaggagctcttcccctctgtaatcccatgtatccaggttgctttttcttgccgacttgggcaatctttgcttagaccacgtaacacacattttctccccccctacctatgtaaaatatctgag

SEQ ID NO: 44706 - DNA, 261 bp, Homo sapiens
cttttatgaaaaaatatctccttcccattctggggctcttcatggcctactactactattctgcaaacgagggattcagaccaaagatgctccaaggaaaggaagttattgtcaaggggggcagcaaagggatcggaagagagaatggcttatcatctttgcggagatttggagcccatatttgtggtgacagagagagcaaaagaaatactacagaggggaggtcccctatctcgcagctctggagcagcctctacacat

SEQ ID NO: 44707 - DNA, 247 bp, Homo sapiens
ataatcaaatgtaataaaagaacattttcatattaatgcataatgaaaactgtacggaataaggttacctaaaggctaaactggccaggtgcagtggctcaagcctgtgatcccagcactttgaggagctgaggaaggtggatcacttaagcccagggagttgaagagcagactttggggacatagtgaaacctgtctctacagaccatacacacattacctcggcatagtggtatacacctcttag

SEQ ID NO: 44708 - DNA, 212 bp, Homo sapiens
ccacctctgtgtcccagtctcaaggaagcctctcctagcagtagacgtgccaaatgcagatacattctccagtcactctgcaaaatatgtccaaatgatttttcttttctggggggacttggaagaattcctgtctaaaagtgctggtaatccccctttctgtggtgtgatactaagagttaagaaaagggggaaaagactgtgttaagtgg

SEQ ID NO: 44709 - DNA, 126 bp, Homo sapiens
gcgtaaacagccccgttcccaaagcgattataaccctgttggatagatgacttcggataacggttccttccaattcttaagggtttggaaaggggaatggagggtcctacgatcggccggaaggcg

SEQ ID NO: 44710 - DNA, 167 bp, Homo sapiens
ccgtaccctagaccttaaatgaccttgtcatcctgtccgctaaaaagcacagcttcccaaccggcaaccgggaatacctccgggggatgggtgggccaacactgtctttcgcctccagagttaataaaaccggtcccccgagagtgctccgcgagggctccctcccg

SEQ ID NO: 44711 - DNA, 121 bp, Homo sapiens
tgtatagaagccccaaggccgtttaaaccatggaggatgagagggaggtagtcaattttggaacccaaggcgggcctcccaaggcgccaattcatggggccctgaacctcgtgtaggggag

SEQ ID NO: 44712 - DNA, 116 bp, Homo sapiens
tcccgaatcctgggtataatgggttttgctccggctctcatgtataggtggcgctttgggtcttgtttgtgctgcgctgtgctagcgctgcaaatagagtgtgctgcttagcgtac

SEQ ID NO: 44713 - DNA, 177 bp, Homo sapiens
aattatgtcatttgtattaaacccagatctatttctgagtatgtggttcatgctgttgtgaaaaatgttttacctttaacctttgtcagtttgtaatgagaggatttccttttaccctttgtagctcagagagcacctgatgtatcatctcaaacacaataaacatgctcctgaagt

SEQ ID NO: 44714 - DNA, 550 bp, Homo sapiens
ttaatgttatagaaatatgtgactacatttttatcaaaatattgaaagaatccccccttttttagtttcagatacctgaactacacagatgagcttctaaaactgatgcaaacagtttctgacactgtataatatgcttttgggtgatttggggggcaaccacaagttttgcgttttgctacttaaatcatcatggctataaataccaaaacgatttggatccatttatgtttgtagggataatatactactgactgacttgactgtcagggtcacaacagctagatgatatatttatgactatgtctaataggtggaaataaaatctgaatattgatttactatacccaagaggggagaaaaataaccattggaaattttaaaaatttttcaaaaatggtaaaatgaggcaaatttaaggttacaaatttggaatttctttggaaattatgaaatggcaggaactacctaagaccgggcctttggaattttatttaatggagggcctggacattggaaacaaaggatactttgtgggtggaaggggaga

SEQ ID NO: 44715 - DNA, 497 bp, Homo sapiens
tctgggctgctggaataggacactcaagacttttgacttgccattttgtttgttcagtggagactccctgggcaacagaatccttcttgatagtttgcaggcaaaacaaatgtaatgttgcagatccgcaggcagaagctctgccttctgtatcctatgtatgcagtgtgctttttcttgccagcttggccattcttgcttagacagtcagcatttgtctcctcctttaactgagtcatcatcttagtccaactaatgcagtcgatacaatgcgtagatagaagaagccccacgggagccaggatgggactggccggtttgtgcttttctccaagcagcacccaaagtcaatgcacagagaccccggtgggtgagcgctgcttctcaaacggccgaagttgcctcttttaggaatctctttggaattgggagcacgatgactctgagtttgagctattaaagacttcttacacatcggaaaaaaaaaaaaaaaaaaa

SEQ ID NO: 44716 - DNA, 378 bp, Homo sapiens
aagacattccagacaagcggtcctcgagcctgtgcctgtcttcagatcttcacagcacagttcctgggagggtggagccaccagcctctccttgaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggtccaaccgcccactgtggactctgaggccctgcatttgcgggtggctgcctgtgatattttggcatggctggctggccggtttcccatttgctggcagctctatgtgcttaatcccttgccttcattaaaagcaa

SEQ ID NO: 44717 - DNA, 491 bp, Homo sapiens
atttagttgagctttctaagagaagcaattgggtttttcccacttcaataatcattttcagtttgactcgtacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagaccctgactgggacatagtttgaaggtgaaaaacttcaccaagctacctttcttgaaaggccaaatgttatgttttcaactactctttccactgtaccataactttcactacatattaaatgacactttataactaatataataggacaatcatcaatgcatatatagccagccttcatatctgtgggtttgcatccatggattcaaccaaggaggaattgaaacactgagaaaaaaaaaaaaaaaaaaaaaaaaaa

SEQ ID NO: 44718 - DNA, 403 bp, Homo sapiens
gtttgccagctgaatgtttatggattcactctctctgacaacagaaattgtcagtttgtaggattttataaaactcaatttccctccaagctgaagtaggcacttaggtacatttactgcttataagaaaggaggtacaattcaggggaaacatacaaatgaggatgaaaatggacagaggtatcaatggggttctggagtctctgtctctggctctatttttaacacctctttatagaaatcactctatctggtaataactgctattcctctactactcagcatacctcactaagtcacaggtggagtgtcttttttaaactctggactcatagcagtgtacaaaataaatctttcccgacatctcactcataagtgctcaaataaaaatgcttagtataca

SEQ ID NO: 44719 - DNA, 440 bp, Homo sapiens
atttgactttttcactagccagttgacgagcagtgcatttacaaggcactgccaaacaagatgcccttgggagctgtgagggaaagaggacctgcgggcttagatcaatctcaattccttttcatgccctcctgcattgctgctgcgtggggatttgcctcgttagccatcaggtacagttttacactacaatgtgagctatagggggagcatcagcagtgggtgaggcactctctatctctagggtgtgcgctgaatgatggtgcacgatctctctcttttgtgaatctttcccccatttctgtttacatgtaacccacaaatgcaatttttagtgcttctgtccaccagttctttctctgggtagacgtacttggctacagatttctgcctcgttttgcggcattgtccctcacacagatattttgggtattaaggaa

SEQ ID NO: 44720 - DNA, 211 bp, Homo sapiens
acttgaaaagaagtcagctgttgcagataaacatgaattgctcagccttgccagcagcaatcatttggggaaggaatctacagttgctgatggacagagtggatgaaatgagccaagatatagttaaatacaacacatacatggggggatacttgtaaacaacagcggcagaaacatcagtatcagcagcgctcgccagcagggggaatat

SEQ ID NO: 44721 - DNA, 170 bp, Homo sapiens
ctctgaagaaatccttaatagaggaccacttaaaagaaggaataatttgatatataattttttttaagttagaaggagccacttaaagttcgaaattgggaaaattaagctgtattcaataacatatgttgaactgtatttataaacacatgagatggaaaagmactttg

SEQ ID NO: 44722 - DNA, 161 bp, Homo sapiens
acagtgctgggaggaggttgagatggatgaattgacagaagtaggcttcagagggtgggtagtagcaaacttcactgagctaaaggggcacgttctaacccaacacattgggacgaatcccaggacttaagggttgggtttttaaattaggcaggcaaaat

SEQ ID NO: 44723 - DNA, 212 bp, Homo sapiens
acttagtgcaagaatcagcatgattcttcagaggctcttcaggttctcctctgtcattcgggtcagccgtctcaagttccatttgcgggagggacaattggtgttacaacaagtggccatttaataagggacctttgaccagtaaaggaacccttttgtggcccagagtggggattaaaaattttgagccacacacactctgtggggaccct

SEQ ID NO: 44724 - DNA, 362 bp, Homo sapiens
attgcaaaatataggtaaatgtatttaaatcgagggatttccagctttctgttggggaatctgttgtttatgtccctcgaagcagggcatggcaacaatctacaggaacagagttagttgggtggcactatgccagctagtttacattccacactgtgaatctggggcaagttctcgaggagtcgcacacgggcaccccatgctttagagatacactcgaggcacacgcagtgcctcacacctctaatgtcagcactctttaggggcgcggtgggcagatcacctcgggtcgggggttcgacgaccaccctcgagaacatcagcgacaacccctctttaccaccgaattcaagaattagccg

SEQ ID NO: 44725 - DNA, 129 bp, Homo sapiens
gactttcctctcagacctggttgacacacgcctcaatgagcctttcctgaaaacagaggggcctaagacaatcttccctcccaattgcctttctttatttttttaaccttttggggggaaaagattttt

SEQ ID NO: 44726 - DNA, 181 bp, Homo sapiens
gaatcaaactttatggaaggcctatcaaaattccaatttagatcaggaagtagtcatgccccacaagatgtcagtttgtcatatccccaacatcatgttggaaattcaagccctacctccacatctcctagcagcaggtacgaaaggactttggataacaggacttaatcaggcacagata

SEQ ID NO: 44727 - DNA, 173 bp, Homo sapiens
agaattgcgtcatttaaagcctagttaacgcatttactaaacgcagacgaaaatgggaagattaattggggagtggtagggatgacacacattggagaagatagaagtttaaagtggaaaactggaagacaaaagtacgggaaggcgaagaaaagaatatgagaagatagggg

SEQ ID NO: 44728 - DNA, 131 bp, Homo sapiens
taaataacttttaatggccaaaccccagatttgtacttttgttttttttttctaactgttaaaaccattttttttccacctggtttttatttttaaaattttggaaagggaaaaaattgttgggccctttt

SEQ ID NO: 44729 - DNA, 193 bp, Homo sapiens
tttaaaaaattccccccatgtaattattgtgaacaccttgctttgtggtcactgtaacatttgggggggtggggcagggagggaaagtaacaatagtccaaatgtccctggcatctgttcagagcagtttgcagatgtaatgctcttttgtaagccacgttttatgattttcaaaataaatttggtgggcctc

SEQ ID NO: 44730 - DNA, 322 bp, Homo sapiens
tattttgtttaaacaaaaagccatagaacttggtcatgttttccattttaaaatgatttactgaaacagagtaatactaataaacacccacaggcaccaaacaggctgcttaaaatgggctgttaaaggcatttttttgggtattggatattactaaggaaaaggtttgcacatcttttaaggggggacacacagagatttccccccttgggtagagagtgacgcggctctcgtgtggggtctctttttggggggcgcgcatagatggcgcacttctttgagagctctagttctccgagtctctcatcacagtatcatgtag

SEQ ID NO: 44731 - DNA, 401 bp, Homo sapiens
cttaagcagagggagtcgagccagcatcgccgcgatggtgttgttggagagcgagcagttcctgacggagctgaccagacttttccagaagtgccggacgtcgggcagcgtctatatcaccttgaagaggtatgacggtcgaccaaacccattccaaagaaaggtcctctggagggctttaagcccaaagacaccagtttctgttaagagctaccgttggaagaggaagatcagcactttggtgagctccaaggaagtaaatatgtttcagatggcttatacacacctcctgagagctaacatggatgggtttgaggagagagacacagagcacacatctaagagaccacagcagcagcagcagcagcagcagcagcatctcccagaagcagcaacaggag

SEQ ID NO: 44732 - DNA, 180 bp, Homo sapiens
atccttcatgaacttagatgcaaaagttctcaacagaatattagcaaattgaatctaggtatttataaccagaagtatacaccatgactaaggggggatttttttttccagtaccaaaagtttgttttgggatttcccccttaaatccagtgtatttccttcacatcaccatatttatat

SEQ ID NO: 44733 - DNA, 310 bp, Homo sapiens
aagccacaaagatgccacatgttagtatatcagtgagaggtgactccacagtgctctctggagaagcaatatgagtgactgaagagtggggccttttgcttttgcctggatataggggtgctcttctactgtaaatgggggttggaaaacccttgccttattgggttcccatagggtcctttccattaaaggagggctataaaatcagggtatccaatattttaagagccacagagtggattcacatattcgagcagagttttgagccagtaaaatgttgagacatcacactttaagacattcagggcct

SEQ ID NO: 44734 - DNA, 265 bp, Homo sapiens
agactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacggctgtcccttccttgatattgcacccttgggcaacggggtgctgaccccagaattctttgtgtgacacatagcccaatctcgtttcaaaaaaaagt

SEQ ID NO: 44735 - DNA, 173 bp, Homo sapiens
acccaaaaccattaaaaccccagaggaaaaccaggcaaatttaattaggacaaaggcaatggcaaaacctcaagaccaaaacaccaaaaacaaagggaacaaaacccaaaaattacaaaagggaacttaaatttaaccaaagagccttttcacagcaaaaggaaccttcttaa

SEQ ID NO: 44736 - DNA, 146 bp, Homo sapiens
gtttctctaaaactgaagttctcagcctgtaacttctcctggaaaaccaaaaaaaacaaaaaaaaaaaaaaatggggccccttggcccaaggggtttgggtttgtaaaattttttaaggccccaaatggggcctttttggccccgg

SEQ ID NO: 44737 - DNA, 208 bp, Homo sapiens
attctgacatctacttaggagtaattgctgttgtggacaatggccccagttttttccatgtaattttacaaatgtaataaaagtcagatatataccatacgtgaaaaaaaaaaaaaaaaaaaaatttgggcccccttggcccaattgagttttagggttggggaaagtttattaattccgccaaaatttgggctcaatttggccaatt

SEQ ID NO: 44738 - DNA, 175 bp, Homo sapiens
caacaaaagccaaaattgacaaatgggatctaattaaactaaagagcttctgcacagcaaaagaaactaccatcagagtgaataggcaacctacagaatgggagaaaatttttgcaatctaactcatctgacaaagggctaattatccagaatctccaaaggacctcaaccaaaa

SEQ ID NO: 44739 - DNA, 201 bp, Homo sapiens
taatctagggcaggctgtattccagtccatgtgttctcggtcgccgtagacagcgctctggctcccaccgtgaggctacttgaactgtcaggggcatctcccttaaccaggaccatttgtcaggaacctttacccacaaacacaaatacttgggttggctctggcccggttttttgggcatttagacctggttagagagga

SEQ ID NO: 44740 - DNA, 234 bp, Homo sapiens
tatatctaagcccttctgcacatctaaacttagatggagttggtcaaatgagggaacatctgggttatgcctttcttaaagtagttttctttaggaactgtcagcatgttgttgttgaagtgtgggagttgtaactctgcgtggactatggacagtcaaccatatgtacctaacaggtgcactaatgcaaaacgggtgtaatattccagggctcggacactctttttccgtgac

SEQ ID NO: 44741 - DNA, 161 bp, Homo sapiens
cttcccgctcagccctccctgcccctcccttcaaccattccccatgggaaatgtcaacaagtatgaataaagacacctactgagtggcaaaaaaaaaaaaaaaaaaaaaaaaaaaaaaaaaaaaaaaaaaaaagaaaaaaaaaaaccaaaagaaagaaaaa

SEQ ID NO: 44742 - DNA, 202 bp, Homo sapiens
cgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttaggattatacccacaaccacccaagagca

SEQ ID NO: 44743 - DNA, 235 bp, Homo sapiens
ttaattacaatttaaagagtattccacataacttcttaatttctacattccctcccttactcttcgggggtttcctttcagtaagcaacttttccatgctcttaatgtattcccttttagtaggaatcccgaagtattagattgaattgaaaagcgcttgccatctctgtctaggggtcacaaattgaaattgcttctgtatcacattcggaggtcttgtgtatctcgtgtgcca

SEQ ID NO: 44744 - DNA, 231 bp, Homo sapiens
  misc_feature 206: n = A,T,C or G
acattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacaggttcnattaacttcctcccccgtttcccca

SEQ ID NO: 44745 - DNA, 220 bp, Homo sapiens
tcatggtgatatttacgccagtttctacaactctggatttgcttgatacctttataggagaaggcaaagagtatatttcggtgtctaacatagataatctgggtgccacagtggatctgtatattcttaatcatctaatgaacccacccaatggaaaacgctgttaattttgttcaaggaagtgcacaaataaaacacgtggcagatttaaagggtcggg

SEQ ID NO: 44746 - DNA, 240 bp, Homo sapiens
cttctgctgagggggcaggcggactttgaggaaaccgcagataagtttttttctcttctggaaagatagagattaatacaactactttaaaaaatatagtcaataggttactaagatattcccttagcgttaagtttttaacgtaattttaatagcttaagattttaagagaaaatattaagacttagaagagtagcaaaaaaaaaacacggagaaaacaagtacatatatttacccccg

SEQ ID NO: 44747 - DNA, 190 bp, Homo sapiens
agacattctgaatcttagactttctgagggggtttaatgaccactagagcttgtcctcatattcagtccagtttaatactgtatgtctagtaagatgggctatatattgcctctattctttgagatgtaattaagcttagaactcttgacctcaaaattttacagtgaaaaattgttagaaaatggggta

SEQ ID NO: 44748 - DNA, 208 bp, Homo sapiens
actgcagaaatgcatcgtatgaaactcatccactgcatgaactactcttgccatcagcggcattcaaaatacattttcagaggaaaaaggtgggatatgaaaatgaaatctgtgtctataaaggaaaatggataggccagggcccagtggccccggctgtactcccggactttagggggcccaaggtgggtagatcactcgaggtgac

SEQ ID NO: 44749 - DNA, 214 bp, Homo sapiens
acctgatttttatttaaaaacacaatttagctttgccaacagaagagtaaaggaaaccataacttataaattttgtaatgtgttcctcctttgttggagacattagccagtgttttagtttttagaccaacttatacagaacagagtattgatttgttacacattctgggagacttgctatatcatggtttgctatggcacagactcagcttag

SEQ ID NO: 44750 - DNA, 211 bp, Homo sapiens
aactgttatcccattgaaaagaccgagccttgtatgtatgttatggatacataaaatgcacgcaagccattatctctccatgggaagctaagttataaaaataggtgcttggtggtacaaaactttttatatcaaaaggctttgcacatttctatatgagtgggtttactggtaaattatgttattttttacaactaattttgtactctca

SEQ ID NO: 44751 - DNA, 226 bp, Homo sapiens
  misc_feature 195: n = A,T,C or G
caaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctngttatttatcaatttttcccagtatttttat

SEQ ID NO: 44752 - DNA, 222 bp, Homo sapiens
cagagccccaattcctacttcatggatgtgaaatgcccaggatgctataaaatcaccacggtctttagccatgcacaaacggtagttttgtgtgttggctgctccactgtcctctgccagcctacaggaggaaaagcaagggttacagaaggatgttccttcaggaggaagcagcactaaaagcactctgagtcaagatgagtgggaaaccatctcaatata

SEQ ID NO: 44753 - DNA, 234 bp, Homo sapiens
  misc_feature 201: n = A,T,C or G
ttttctcaccccacatcgctcccctttttttaaaaaggactgttttgctagtgtgataatgaataggtaagatatgagataattgcaacattgtctagttctagtatggtaactattcttgaaatggtattgaaaaatacccttaattcaaattgacagagattgataaagagaaactgatttacctaagtttactttttnaattgcataatagagcatttcttgttttgagtg

SEQ ID NO: 44754 - DNA, 192 bp, Homo sapiens
ttttatgatgagattgcagcaattcagtcatatgttcgggctccacttctaattctagttctcttgctatttctaccacatctgcagttacttcctccactgatgtcttgacaacctcaaagtcatttatgagatcagatgagggttgaaatcaacttcttccaaactcctgttaatgctgatatttttacc

SEQ ID NO: 44755 - DNA, 221 bp, Homo sapiens
tgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcccttggctgtgaataaattggataagacttttttattgtaaggtccagctg

SEQ ID NO: 44756 - DNA, 294 bp, Homo sapiens
tctttgatttgatcaaatatggtaatgtaatttgccattctaacagatcaaaatcagaatcagtatgatcatctatcttgatttgcgagagcatttgataatattcacaatccatttatgaaaaagctcttggcagaggagaaacagcaaagaatttttcgaatataaagggtatgtacaagactgtagtaaccatcttactgagagatcaaacttgttccctttcagcttgggaatgagtcagagcttctattcaagaccaccaatctacttatctttgagcatgggtatctc

SEQ ID NO: 44757 - DNA, 199 bp, Homo sapiens
cagagttgttatatacaggagtgtcttatgttactaaaacattccagccaaaggactttcagatgtgagataatgatgggtcatcaataaaaagctataatgcctaggttactcagcaggagaaacagtgagtgtcttcaagtgacttgctcacctaaacagtttgtgtcttcatattatgcacataactgtctctatg

SEQ ID NO: 44758 - DNA, 153 bp, Homo sapiens
aaattcatcattcatgcccctcctggagaatttagctgaggttttcaatgatgttcggttactgcttgataatgacaatcttctcaggggaggggcaggccatgcagttgggtcatggagcacttcagtaggagtctgctctgagagcttacg

SEQ ID NO: 44759 - DNA, 235 bp, Homo sapiens
aggctgaaggaaatagcaaattcacctacacagttctggaggatggttgcacgacacacactcgggaatagagcaaaacagtctttgaatatcgaacacgcaaggctgtgagactacccattgtagatattgcaccctatgacattaggggcccgatcaaggattttgtgttagacgttagccctgtttgcctttttataaaccagactctatctggacatcccaaaaaaaaaaa

SEQ ID NO: 44760 - DNA, 227 bp, Homo sapiens
agacaagtcagatcattaaactatcaaaagagaattagtaaattgacagctagagttaaggcagacagtatgcagaatatagcacagaggacatgagacaaaatatgacattaaaaagtcatggcaaaatagcataacataatactcttctatcagactgtttcagaggagcaacagacaagcataggagctaagcatgtattagtcgctgactgttttttgagagt

SEQ ID NO: 44761 - DNA, 142 bp, Homo sapiens
acttttatgaagtattattgactatagccaactacagatggcatatgccttgccagaatgcatttttctatggtgtttgcatattttatgtacaggtgaaaggtcaggacctcatttgcaggactttgaggggatcctttag

SEQ ID NO: 44762 - DNA, 268 bp, Homo sapiens
ctcagaagtttataagataaaacatttagaaacagctaactacccaacccaataaaccaaatcattggtgtcttttagtttcttatgcttagggaaaacaaataagggactgtggaaggcaaaagcttcatctctgtattctaatttgacaatgcatttgatacctgtggcctttcagcatagatattgtataccccttggggttattggggtagttaatataggtgtccgcagtgttggttctgtctcgacaggttactcagtgtgt

SEQ ID NO: 44763 - DNA, 237 bp, Homo sapiens
gataaatgtgaatctgcaatggctgaaaagagttgtgagcttttttattcatgataaaaccttataggaatagtataaaagatccctgtggaaagctactagtacattgaccagcgctgggtgatacagattctgataaaaacataaatgtattagttcatctccatgtagtaaaagtatacttatacaatgttctgtactgctattcatgagattaatcagtgatgctaagaccaa

SEQ ID NO: 44764 - DNA, 147 bp, Homo sapiens
aagctagcagaaggcaagaaataactaagatcagagcagaactgaaggaaatagagacacaaaaaacccttcaaaaattaattaatgcaggagctggttttttgaaaagatcaagaaaattgatagaccgctagcaagactaaaaaa

SEQ ID NO: 44765 - DNA, 221 bp, Homo sapiens
tgatatatttcatagcaggaaaatggaggaaatacatgtccataatcagaggatttgaatcaaggatgaaagcttcatgatgtaaaatattacatggcagttaaaaacaattggctagaggtaagcccatgamtatataggatagaaatataatatttccctgtagtttgagtgaaaaagaaaaaaaaagaatttttaggtctacaataaaacataatttt

SEQ ID NO: 44766 - DNA, 119 bp, Homo sapiens
aatgcgcactatgagaactactgaagcagaaatcttgctgctgcgacttataatggaggtgatatcaacaagaataaagggcagctgactaagagccctctggcgcaaaaaaaaaaaaa

SEQ ID NO: 44767 - DNA, 518 bp, Homo sapiens
ttagcatcctaggtcattgcaaaatataggtaaatgtatttaaaatcgagggatttccagctttctgttggggaatctgttgtttatgtccctcgaagcagggcatggcaacaatctacatgaacagagttagttgggtggcactatgccagctagtttccattccacactgtgaatcttggcaagttctggaggaagtggcacagtggcaccagttgcttaagagatccactggaggccagacgcagtgactcacacctgtaatgccagcactttttaaggccgaggtgggcagatcacctgaggtcgggagttcgagaccagcctggagaacatggcgaaaccccatctctaccaggaatgcaagaattagccgggcgtggtggcacatgcctataattccagctgctcgggaggctgaggcaggagaattgcttgaacctgtgaggtggaggttgcggtgagccaagattgcaccagtgctctccagcctgggtgacaagagtgaagactgtgtc

SEQ ID NO: 44768 - DNA, 409 bp, Homo sapiens
aaagtttgtctagcactgtactcaaaccaagttttaattgtggctgccgccttcaaagatggggaggactactctcttcatgatgtagtaggagataagggattggtttggtctttttcaataaagataggggttgctgaagttttctgaagggaataatgacttacattgtgaccttttagattcggtgttgagctctgtgttgtattacttcctaaaagataatgcttaaacattaagcattaagtgtgctcttcatgttaatatggcagagttttgtaaactaaattaaaacttactgatatattggactttgagccaagggaaagaatgagtactatctttccagatatcttaagggtaaaagcttattctaagacagtctgtccaatgagaatattagatttcc

SEQ ID NO: 44769 - DNA, 226 bp, Homo sapiens
gcgcagtaacatcctgtcaagttttcctcccactgtatgtaaataactttgaacggccaaaccccagatttgtacttttttttttttttcaaacggcagaaacaaatccccttccaccgggttttacggtaacatttggaaaaggaaaaaatgtcgtccctttgaaaaaaaaaaaaaaaaaaaaaaaaatcctggggggggccccccgggcccatttcccccggat

SEQ ID NO: 44770 - DNA, 257 bp, Homo sapiens
ttgttatttagcactaagaataaaggctgcattttcacagataaattggcattgctgctggtgacataacaaccaacatactgaatctgatgtacatacaggtttctacaggcagagatggtatacttcacaatttggagatttaataaccagggctacccagaaagcagtgacttgataacatggtaccagtaagtaagggatgctctctcggtttgcttttgccactgtcaagattttcacttctcaggttatta

SEQ ID NO: 44771 - DNA, 267 bp, Homo sapiens
aaatatgtggaagaggagcagcccgaggagttttttatcccctatgtctggtctcttgtctacaactcagcagtcggcctgtactggaatccacaggacatccagctgttcaccatggattccgactgagggcaggatgctctgccacccggacccctacagccaagcagcccttcaagttcttttatttctgggtaacagaagtagacagacaggttacttggtgtatcttctgttaaagaggattcacgcgtgtgttttctcaca

SEQ ID NO: 44772 - DNA, 214 bp, Homo sapiens
ggacatatcttcattcaaagtatttgctgggcttaccactgccttggcaaggttggacaagcatctggcagtcagggcaaggactgttggaggagagttagcccagtataggctctgcccagatgccatcacatccctgatactgtgtatgctttgaaggacctgccctgagaaggggagggggggtatttgggatagggtcttgggtcccgcc

SEQ ID NO: 44773 - DNA, 207 bp, Homo sapiens
tgatgatgattgtgtagtgactggccgaaaatgtacggatgtgtgagtcctctggagccaaaatggatcggtaactgtttgaaacatatccaagcatgctgaatgatgtggccgggatgagtgtcaggatgggagtattgtccacatataggggaggccaaatcaccaccaggccacttaaggcccgaatggcttacatgttccaag

SEQ ID NO: 44774 - DNA, 221 bp, Homo sapiens
gatatttgtcttctggtttgagctatttcaaataatgttgcactgaacaaacttgcacatgtgttcttgcaaacttgtgactgtaatttctgtgtcaagggattaaggtttcggtcttcagtgagtcaccattgataaatttgagtacacaccttaggtctgagctatgaccagtcacacttcattatatttgctaactcctgagtgctcagctattttgm

SEQ ID NO: 44775 - DNA, 213 bp, Homo sapiens
aaatcaacttgaattgataaatgtttgattttcaaattctaatacgttttaattttcacattttttaagttaaaatgtgcctaggacatatctattatgctttgagattaggattagcatttataaacctttcatttattctttgtgtttaggagatgtgatgattattgacaattggctcagttttactaggggtgtgagcccttatgtccy

SEQ ID NO: 44776 - DNA, 140 bp, Homo sapiens
ttacaaaacatatgagccatcacgccatgcgcctacacttggcctaatgccacctttctgtacatactgatggtcacgtatccaggaaattcatttgttgggcaacattcggccccaaatcatagttcccgacaatggaa

SEQ ID NO: 44777 - DNA, 232 bp, Homo sapiens
tctctacaaccctctctcctcagcgcttcttctttcttggtttgatcctgactgctgtcatggcgtgccctctggagaaggccctggatgtratggtgtccaccttccamaagtactcgggcaaagrgggtgamaagttmaagbtcaacaagtcagaactaaaggagctgctgacccgggagctgcccagcttytttggggraaaggacaaatgaagctgcttycagaagct

SEQ ID NO: 44778 - DNA, 246 bp, Homo sapiens
ctgaagatggcggcctcaacagcgcgaggtgctgcggcgctgcgtagaagtatcaatcagccggttgcttttgtgagaagaattccttggactgcggcgtcgagtcagctgacagaacactttgcacagttcggccatgtcagacggtgcattttaccatttggacagggagactggctttcacagaggttcgggttgggttcagttttctccagaggagggatttcggattgcactacaacagga

SEQ ID NO: 44779 - DNA, 226 bp, Homo sapiens
agaatttggaaatgattctgaagttcatctcaaagagtaaacaggtaggaataacaaaaagtattttgcaaaagaatagtaatactaagggagaagacttaacttacgagatttttaaatgcttaatgacgattttgccatcaaaacagcatatacatcaaggtaaatttcaaaatatatcccatataggaccactgtccgttgtcttaaattcttgggggttaca

SEQ ID NO: 44780 - DNA, 213 bp, Homo sapiens
caattgaatcttctagctttacaaacctaaagccaaaggaagggaagcccacggaggaatgcagaagtcaaaccctcatgacaaagtaggcacaagtctacgataagctaaatcagattttacaaatacaagttttcccaggtggcatttactcccctcattgggagtggaatggtatcgaagtttaaattaagccctatggtaagggaacca

SEQ ID NO: 44781 - DNA, 228 bp, Homo sapiens
acagatagaaagcctcattagtcctgatggttctcgtaaaaaccccgctagagactgcagagacctgggaattctcccatcctgacctaaagagtggagaaatactggtttgcccctacccaaggataacaattggatgctatcagggtattctataatatggaccactgggggacacaaacatcggccccactcctttgtgtgtcccgcgcacacactgggggaaag

SEQ ID NO: 44782 - DNA, 142 bp, Homo sapiens
accccatcgtctcagcccaaaaatctccttaagctgataagcaacttcagcaaagtctcaggatacaaatcattgtcccagaatccacaggcattcttacacaccaccaccagccagacagggggccaattcatgagtgacc

SEQ ID NO: 44783 - DNA, 132 bp, Homo sapiens
ccaaaccatttacccaatagggtataggcgatagagattgaaacctcggcgcaatagatatagtaccacaaaggaaaagatgaaaaattataccccacgcataatatagcaaaggcctacccccctatacct

SEQ ID NO: 44784 - DNA, 234 bp, Homo sapiens
cattcgggccgagatgtctcgctccgtggccttagctgtgctcgcgctactctctctttctggcctggaggctatccagcgtactccagaagattcagggttttactcacgtcatccagcagagattggaaagtcagatttcctgagttgctatgtgtctggggttaatccatccgacatagaggttgactcactgaggggtggagagagagttgagaaagtggagcatacaga

SEQ ID NO: 44785 - DNA, 249 bp, Homo sapiens
  misc_feature 218: n = A,T,C or G
acagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagagggccccgacagttttagaagctgcttctccgaatttngcaattacaatatagaaaatcacctcggagc

SEQ ID NO: 44786 - DNA, 244 bp, Homo sapiens
aatcaagattgagagtggctctaacaagtgccatttttccttgttagctttcatttctcagccctttacaagattaggatagtctgcaggtttaatctctccagaagctttacggacagtgattctgtcctaaacaggacagtgcctccaggatttctgaggactattgtggaggaggcatccattaaggccaagctataacatcagagatggtgattgattacgcgagtttcttttgctgaga

SEQ ID NO: 44787 - DNA, 246 bp, Homo sapiens
cagagctgaagatcaagcgcctgagaaagaagtttgcccaaaagatgcttcgaaaggcaaggaggaagcttatctatgaaaaagcaaagcactatcacagggattataggcagatgtacagacctaatattcgaatggcgaggatggcaagaaaaggctggcaccttctatgtacctccagaccccaaattggcgtttgtcatcagattcagaggtttcaatggagtgcgcccaaaggttccgaga

SEQ ID NO: 44788 - DNA, 211 bp, Homo sapiens
cagatctgtttctcaaattgagatacttgatgtttttgctgggtaggagggagaaacaagagggacagtgggccagttcacggagactttagcagtagggttctggggcgatgttgcggggagcagcatgatttatcacacaccctccctgtacccagagagtccccagtgtctgtttttctaatcctacataaagcccctcttcttgtcc

SEQ ID NO: 44789 - DNA, 181 bp, Homo sapiens
accaaaattttaagtaggaaagtcacccaaacacttctgctttacttaagtgtctggcccgcagatactgtaggagcagagcatgatcttgttactgtgatattttagggtatccacagtactcactttttccagtggatcctggtgattccctagagaaatctttctcttcccttttatt

SEQ ID NO: 44790 - DNA, 339 bp, Homo sapiens
tctggtagggctgggcttgcaggaggatcaacatgcctttggctagagatttactacatccgtccttggaagaggaaaagaaaaaacataaaaagaaacgcctagtacaaagtccaaattcttactttatgggatgtaaaatgtccaggtttgctacaagatcaccacggtttttcagccatgctcagacagtggttctttgtgtaggttgttcaacagtgttgtgccagcctacaggaggagaggccagactcacagaagggtgttcatttagaagagagcgacacttatgattcacacagcttctgacttttaattttgtgttgtctcacagagagc

SEQ ID NO: 44791 - DNA, 343 bp, Homo sapiens
acagcttctccaagcatcaccctgggagtttcctgagggttttctcataaatgagggctgcacattgcctgttctgcttcgaggtattcaataccgctcagtattttaaatgaggtgattctaagatttggtttgggatcaataggaaagcatatgcagccagccaagatgcaaatgttttgaaatgatatgaccaaaattttaggtaggagagtcacccaaacacttctgctttcacttaagtgtctcgcccgcaatactgtaggagcacgcatgatctagtgactgtgatatgttaaatatccacagtgctcactgttttcacatgatcctcgtgaattgt

SEQ ID NO: 44792 - DNA, 209 bp, Homo sapiens
gcaaaactttaagatataaatatattaacctattaagaagtctaaagattgttttggagaaactaccatctctatcaaaaggcatacaagatctgaatgaatacagagataaaccatgttcatggatggggcaacttagtattttaaagaggtcaaattttgctaaattaaataaaacatgtatagacttccagtcaaccttatatcag

SEQ ID NO: 44793 - DNA, 265 bp, Homo sapiens
ggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagacacgcaagagaaaaatccacctgccttccaaagtaacgattgaacaggagaagcaagcaggcgaatcgtaatgaggcgtgcgccgccaatattcactttacagttcacaaaggattgccgttttatttta

SEQ ID NO: 44794 - DNA, 212 bp, Homo sapiens
gaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctaccgttgaagtgaagccaaagcccagttttaaaaggattggacaaccagctgg

SEQ ID NO: 44795 - DNA, 300 bp, Homo sapiens
atggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtatttagtccaaaaaaaaaaa

SEQ ID NO: 44796 - DNA, 411 bp, Homo sapiens
cgctcgcgccgagtacgctctccaccagctggccaagcgtgacaagaactgggctcagcgtgagcccggtgtcatcgtcgtctttgtcattgttttcctcgtcgccgtcctggtcattgccatgttcatcaacaagaagaggcaagccgccaaaggcgtcgcataagatacccccttgattcgagttggagcgcagccgagcagtacgatatgaaggaggacaagacatgacccccgatacgaagtcataaagctgtatgctggacgggcacgagcttgtgtataatgtgtttcaatatttgcgtataggataacgcgggctttccttgatgggactgcactgtggtgcgaacgcctatattcctaggcttcgtagtaataatgaacaagtcaaatacccattggaaaaaa

SEQ ID NO: 44797 - DNA, 219 bp, Homo sapiens
agcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttcttgcctttttttttttt

SEQ ID NO: 44798 - DNA, 544 bp, Homo sapiens
ctaacaatgaagatgtaataataactaaaatatattgagcatttataatgtcccagtgatgaacacttaccaggtgttaaatgacttaattctcccaataatccaaaatataagaatgattgtcataaataaggacaatgatacatagataattttaataattggctgaaggtcatatcagatagcatgcaataaagctagaatacaaacacaagagctccatctaagttcttctactaagcacattatccctccatatgtttataaatagctattcatttagacaaaagttctacaaacaggggtcatactgtctacagattttctaaaacctcagacatacttcttatatcataaaagggataaatttcatacgtaatgatattgtattaatatatcaatactattaatatatatgcttacatagacaattactcagttcaatataggctggaatttttcatgaagcagatctgctttgggctctattcaaaaataatttagatgttgaaaaaccaaacaagtcaaaaagagcaaaaaaaaa

SEQ ID NO: 44799 - DNA, 210 bp, Homo sapiens
gattaaagagaacttggtctagttcataatatttttcatagggctttccctggctgctggaaaacttaggccagtaagcatctcttttgtttaaagtcctacaagacaatttgaaataattcactgttcawgccaaaattctaaggacctgtttttcataggcagtgttaacgatattcaggaccattgggtccaggtaaacgcatcctb

SEQ ID NO: 44800 - DNA, 244 bp, Homo sapiens
ctgaacaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcaggaatgtgtctctctgatcatgggtgctcgggtccagctctggggaggcccgagaggaactcgagtaagctgcgcgttggggagaggctcttattaccg

SEQ ID NO: 44801 - DNA, 178 bp, Homo sapiens
ggtcaggtttggagttttcctcttatgctgttaagttggcacttcatgggtttcaggttttagagcattttgaattttagatttttgaactatactcaacccgtatataaacactacacagtaaaaattgaactgagaattaagcatcattaaacagtttcaaacattaatttattta

SEQ ID NO: 44802 - DNA, 239 bp, Homo sapiens
tcagtggcccatttctgctttccgtcatcccactcccaagccctggtggcctttttccaaagatatagtggtaggggcttcccaaaggcgatccaaaggcatactcctaccgtttgcccggcccctgctggtggctgcccctcgtcgctgcgggtccccaaagtttgtgaggccctttgtgcccgcgctcgcttccagaaatacttccgcttaagaccctcgtggctctcaaactccct

SEQ ID NO: 44803 - DNA, 238 bp, Homo sapiens
ctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcggatcaccctaacaggccgcaacgtagaaatccttggaaaaggtgtgtgctgacttgataagaggcgcaaaagaaaagaatc

SEQ ID NO: 44804 - DNA, 229 bp, Homo sapiens
acaaacacacccacacgcagtctttgcagtatctgacagagaactcacagggagttacttcaagcacttgccagtactatgatattcaagtaccttgcagcatttctctgccattgctttcaatgaggccagagcatcctgtgatattagacctattatactgtaagaatataagtataaagtgcgttcatatacatgtgagggtttctttgcttgagtggacagtagc

SEQ ID NO: 44805 - DNA, 240 bp, Homo sapiens
atcaagaatttggtgtggacgttggccctgtttgctttttataaaccaaactctatctgagatcccaacaaaagggatttaactccatatgtgttcctcttgttctaatcttgtcaaccagtgcaagtgacccacaaagttccagttatttatttccaagatgtttggaaacagtataatttgacagggagaaatgatacttctctttttttgctgttcaccaaatacaattcagatgct

SEQ ID NO: 44806 - DNA, 232 bp, Homo sapiens
ttgtgcatatcagtagttggttcatttttatttgcagaataatattctattgtattaatatgccacacttttcttatccattcaccaattaatgaatatgtaggtcatttcacttatattatgttatcagttattatgaataaagctgctgggaccacttcaagtaaaggtctttgtgttgacagacgtttacatttctctagggtaaccacggaggagtagaaattcttga

SEQ ID NO: 44807 - DNA, 235 bp, Homo sapiens
cttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgtttt

SEQ ID NO: 44808 - DNA, 244 bp, Homo sapiens
aaattacccttcataagtcacagagaaataaagactctctgagacagagacaatgagataatttgtcacaagtagacatactttgcaaacccttttcacagggattatttaaagagaagaaaaataatatgtttcataaactgagatctacattaaggcagagcatcagagaagacatgtatcaagataccatcccctgatgtatttcctgatcataattcacccaataggtaatgtttgttcc

SEQ ID NO: 44809 - DNA, 224 bp, Homo sapiens
actgagtccaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagc

SEQ ID NO: 44810 - DNA, 237 bp, Homo sapiens
attcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaacatgaaatatagcatgttttgtttccaaataaaattg

SEQ ID NO: 44811 - DNA, 253 bp, Homo sapiens
cttttaagccccttttgggtccttggacccaatttccattggccccctatcagccgcctggcagacctcagcagccaagaagggtaagcagaactgagagcaagactgtcctttcaggaagcccttgacgcctcagggtaataacctttgggagagttccccttctatccacgcggagttgggccattcaaaaaagttactagccactttttctaatccgctctgtaaagaaattcaacgaggaaatatccct

SEQ ID NO: 44812 - DNA, 417 bp, Homo sapiens
ctccagagagcagacatagaggagataaagagttggaggctaagcaaagaactggatttagtaagtcaccatgtgaggacaaaacttgatgaactgaaaaggcaagaagtaggaaggttaagaatgttaattaaagctaagttggaattcccttcaaagatatagggcatgtgaccccccaaagctcttctagagccagatttgagtcaccctagaaccaccctgaagtccctgacagagttttgcctccacagatttaggatagtgctaagtcccgggcggccgccagggttgattctgggcccctattgccacgcctcgccatggagagtctcgcccgtttgcgctgatgagggcccttgcggggggaggtcttccccccccttcgttgtggggtggggggggcggggagggtct

SEQ ID NO: 44813 - DNA, 142 bp, Homo sapiens
tttctcagcagccgttaattgtacattttgcactaactctgggtgttgcgcttcttgtaagattgcgctttgtgcttcagtttgttacctttgtaggcttatttaatgaaaccattcaaataaaccaaacttgcttttgttg

SEQ ID NO: 44814 - DNA, 204 bp, Homo sapiens
tatagttagggattaattacttaatagagaaatcctaactatatcacacaaggggatacaactataaatgtaataaaatttatgtctggaagctaaaaaaaaaaaaaaaaaaaaaagaaaaaaaaaatttgcccccccccccccaggtggttttggggcttggggaaaatttttaaattggggccccaatttgggggtttattt

SEQ ID NO: 44815 - DNA, 169 bp, Homo sapiens
tcttactagaaacaacggaaacctctccttcctcaggatagtgatgtgttcgacgttttatcaaaggccccctttctatgttcaagttagttttgctccttctgtgtttttttctgaaccatatccatgttgctgacttttccaaataaaggttttcactcctcagaaa

SEQ ID NO: 44816 - DNA, 234 bp, Homo sapiens
agctataagtctgagttgtgaatttgactagtaatgggataaggaaaccaaggcaaacttcatctaaatatgtatgtaaagggaatgcttgtaaaggtttggctttttcctcattttgaggtttcagttgccaggtgactattgggatgcaaaattaacaattctgcctaaagggggggaacgagtagaggggtaattcttaaatagccgggcccgttgtgttcactattaaag

SEQ ID NO: 44817 - DNA, 357 bp, Homo sapiens
  misc_feature 353: n = A,T,C or G
actcagaatggtccagcgtttgacataacgacggagggttttctacaatacaggctctgacaggacttggctttcccggaccccttgtaataggattgtttacctttataccaaggaggttgggaaagcaccaagatcttcatgtggggtgttcccaagcagacttcgaggggttcctgctgtaagacccaaagtttcttattagatttccacaacagagggacatgtcaccagggctattgtggttccatgtgttctaaatgtgttcgtgacacgatgcaagcgttcttttcttatcgaggagcaaaagatcccttgttaaagtgtttaaggcacaagcacagagtcagggnggcc

SEQ ID NO: 44818 - DNA, 270 bp, Homo sapiens
gctgagtggttgtgtggtcgcgtctcggaaaccggtagcccttgcagcatggctgaccaacttacttaagagcagattgcaggattcaaagaagctttttcactatttgacaaagatgggatgggactataacaacaaagggatttggactctaatgagatctctttggcagaatcccacagaagcagagttacacgacatgattaatgaagtagatcctcatgggaatagcacaatttactttcctcaatttcttacaataatggcaaa

SEQ ID NO: 44819 - DNA, 316 bp, Homo sapiens
atcacctcacagtttcaggagatgtgacatttgggaaggatgtttcattaaagggaacggttatcatcattgcaaatcatggtgacagggttgatataccacctggggcagtattagggaacaaggttgtgtctgggaccttcggatcttggaccactagttgaaagatatcttttgacacttaaataaatgggctagggttcttacaatgaaatgttctctaggggtctaatttggcaggttctttactatgttactctaccccgcagtgttgatttttaaaaaggggtttctgcagtatgcttttagtctaaga

SEQ ID NO: 44820 - DNA, 240 bp, Homo sapiens
tgttgcttctcttttctctgtacacaggttgagagttaccacagtggcctttcgggtccaccctttgggccaggcacagctctctgggagggaggaccttcctacctattctgacgtttttgccctctgagggaaatggcctcaggtattgtatagacatagcaagaggggaagggctttctcactctagaaaccatccctccattacacaaagggagccctcttaagaaaagggggaga

SEQ ID NO: 44821 - DNA, 210 bp, Homo sapiens
aaaaatttgggtaattccttttttaaaaccagaattttaaagcaccgggctttaaaataggtggaaataataaagccaaaataaaaagaacctttctaatggaagaccttttccttctggcagggttttcctttaggttttcccccaaaacagttaaataatcccaaaactttattacaaaaggtgttccagaacgcagggaaaattggg

SEQ ID NO: 44822 - DNA, 212 bp, Homo sapiens
tctgatcaagaatttggtgtggacgttggccctgtttgctttttataaaccaaactctatctgagatcccaacaagagagggtttaactccatatgtgttcctcttgttctagatcttgtaaaccaggtgcagggtgaccccacaaagttccaggttatttatttccaaaggtgttttgggacagtttaatttgacagggggggggtgagta

SEQ ID NO: 44823 - DNA, 166 bp, Homo sapiens
agtgacttccgttgcagaccaagagccgcctcacctaacaagacccttcctttcatagacaaggtttatgggctgcaagggaggtcaaggtgttttttttacccaaagggggttttatttttcaaggaagtatatttttttccccctccttttttccaccgtttat

SEQ ID NO: 44824 - DNA, 231 bp, Homo sapiens
gagaagttgtattactccaatgagaatactataaatgataacattttcatatattagttggttctcatgcatacataatctaattttgatttgatcctcacaactgtttaagttttattaaatatacattatccctgtttgtttaagtgggtcatacaataccgcctcctttaattcagcgaaattttctgagtttttttcctgttgtgtcccaccatagtccaacgtatc

SEQ ID NO: 44825 - DNA, 201 bp, Homo sapiens
tcaattattctttctgggattggacctttagccctcgaggttcaaaataaaatttgatgttgagaataaaagccttagatagaaggggaattcccaaattttgaaatttgttccccaatcccatccaaaatccctctgtgaaaagaaaatttttcttaaaaccgttttcaaaaaagcaaaatctttttttgtgggccccac

SEQ ID NO: 44826 - DNA, 200 bp, Homo sapiens
ttttggctgctaaattcttcaaaattttgtaaccttttttatttctttgggtgtaaaagcgtttttggcttaagtattgtgaaaattgtataatgtttttgtccccaaattgtatagaaaatgtttcagaccaaaaaaccccctttggctgctggaaattaaaaccactgtgaaaggattttccctgttttctgttagaa

SEQ ID NO: 44827 - DNA, 138 bp, Homo sapiens
tcaacaataaaaccagattatggggctgcttttgtcacactagcatagagaatgtgttgaaatttaactttgtaagcttgtatgtgggtgttgatcttttttttccttacagacacccctaataaaatatcatactaa

SEQ ID NO: 44828 - DNA, 235 bp, Homo sapiens
tttctgtagcattaaattgtgaagacaacttgagtggtacttactgaagaaactctctgatatgtcctagaataagaagcaatgattgttcttcttcttatttttccttgcattttaaattctcagccaaccttcagccattatctttaggacagtgatatcaccatgacttcacagacattggctagattctgtacccctatccccacatttagggtataaatttttttagggk

SEQ ID NO: 44829 - DNA, 125 bp, Homo sapiens
ataaatatatattatataccgctattacacagggaaattgtttcagatgtttatttgtataattacttgattcacacaggtaggaaagatgaatgtatttcccgtttttgaaggggaggataaat

SEQ ID NO: 44830 - DNA, 177 bp, Homo sapiens
tactacactgaattgcacccccactgagaaaggtgaggtatgccttccggtgtggaccatgtgactttgtcacaacccaagggtagttggagttggatcccgggcaatttgagacagcattatttgagagggtttgaggggttccccaaatttgggatttgagatgaattcacaaat

SEQ ID NO: 44831 - DNA, 220 bp, Homo sapiens
ccattgttacaagtttataatgtatttgtctatcttgttttatatgtatgttatataacattcaggaagaatttttttcttgattgagaaaaggatacaaaatgcaaaatccacaattttgataactgaaaattgccaattgttttgcagtactttattatattgggtgtcttgtctttttggggcttttagggtagctaatgagtgtagtacattatgg

SEQ ID NO: 44832 - DNA, 251 bp, Homo sapiens
ttagtaaacctggacggtgaagtgattggaattaacactttgaaagtgacagctggaatctcctttgcaatcccagctgataagattaataagttcctcacggagtcccatgaccgacaggccaaaggaaaagccatcaccaagaagaagtatattggtatccggatgatgtcactcacggccagcaaaagccaaagagcttagggagcccgcacccgcgctttccagcccgttgtctcgggggcgcttta

SEQ ID NO: 44833 - DNA, 320 bp, Homo sapiens
atgagagttttggatgcagtgctcgctgttgctgaataggcgatcacaacgtgcattgtgcttctttctttgggatatttgaatcttgtctcaatgctcataacggatcagaaatacagattttgatagcaaagcgacgttagtcgtgagctcttgtgaggaaaggcattgggtttatcctcttttagagggtagactctttgggggtgggttaaaagaaaggggtttctaaaacctctctctctctagggatatatttcccgggctctagagaaaggattttagagatctctctctcataaaataatatcgggggttct

SEQ ID NO: 44834 - DNA, 286 bp, Homo sapiens
tcatggcctccaaagtttaattttgtggaaagtaactgttagatggaggaatatggtgacccactattgttgagaaatttgttttccacttgtcacgtcacataagatgattgctaagatattgtactggtgttcggtggtgagtcatatttttgggggtttaataattatagaatgggaaatttccttctaatattgtttggaactcttctatggccatatccaccctcagacactgcctctagctctgtcataaatatgtgtgagtgcccccagagagtattgt

SEQ ID NO: 44835 - DNA, 344 bp, Homo sapiens
tagacaaacctaccattgaatctgagatttcaacaatcctttatcaatgtctacatgttttatcaataactggtgtaacaagtagactgagaatcagtagggatatagaaggcatgaacaacatcggtcagctagacctaatagacatttacaggacgttcatcttacaacaggaggatatattctttcaagtgcagattgaagtatttatcaagatagagcatattcttacatatataggggcacaatcacacatttggggagttttgtgtacttctctcacactatattgagttgggcaagagatcagtgacagagagacatatattgtgatatctccacag

SEQ ID NO: 44836 - DNA, 398 bp, Homo sapiens
tatcctttgatttgatcatggtcattcattcattcattcattcacaggatatttatgatgtatttactctgcaccaggtcccatgccaagcactggggacacagttattgcagggtggacaaagcatttgttcattttggagcttagagtccaggagggttacatatgtttattgacacaatcaattttaaattgcggttgtcccaggtgtaattgaggggggttgggggcgccttgtgtttgtgtgccgggggcccaccccttttttggtcggtcttttccctcggccccccttccccactaacatttgggcgttagttggatatcgtagcatatacgactcgtcgccccctgtcactgcgccactacagagctcagggccctctatagtaggggag

SEQ ID NO: 44837 - DNA, 352 bp, Homo sapiens
acatgcctctcgcaaaggatatccttcatccctctccagaagaggagaaggaggaaacacaaggaagaaacgcctagtacagagccccaattacctacttacaagggatgtaaaatgccccaggataactattaaaatcaccacggttctttggcccatgcacaaacggtatgttattgtgtgtttggctgcatcccactgttcctctgccccaccctacacagggggggaaaggcaagcgtttcacagaggggtgtttccctcaaagggagggggcccgagccaggtaagcgcacttttggggccaggtgtgagggggcacccctatctcttctacacacattagggtata

SEQ ID NO: 44838 - DNA, 417 bp, Homo sapiens
aacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctgtgtacaagttggttggactgtcatagctgactggtctgagagctttgtctcaatgtgatctagagactctcatacgcccctctgtatcgccgatcacactctttagagcccaacttgctcatataacacaaatgtcccattttgggtgctctgtccctcgagcctctgacaaactcgactacttttctttgtttatttgtgaccccgtgttacacccaaataataaaatcacccctttcgctgtttgggcgcaagagt

SEQ ID NO: 44839 - DNA, 133 bp, Homo sapiens
catgtttcagattgaccttaccaagttggtttaactttgtaatttaatctgttgtccccttcctttctttgccctccctttttgtgccctcccaaccaaacccttttgccttttgtagctttcatggggcaat

SEQ ID NO: 44840 - DNA, 350 bp, Homo sapiens
ctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaacagactggttaatgataacaatgcatcgtaaaaccttcagaaggcccaggagaatgttttgtggagccactttggttttctttttttgcgtgtggcagttttaagttattagttttaaaaaacagtactttttaatggaaacacttgaccacaggtttttaacagaaatttggggacccttaaaagagggagatggg

SEQ ID NO: 44841 - DNA, 204 bp, Homo sapiens
cgttgtgtgtcattgtgcgttgctggtcattacaccagctgctgcggtatctgctggctcttcgtcgaattgggcggggcggttagccattcttcccgcgagcgattttaaaactaagttccggggcgccaaacttttcccagggggtgctggactcccattttcttagggtggggtgctgttagccctcctgttttgggcccc

SEQ ID NO: 44842 - DNA, 188 bp, Homo sapiens
acactcctgcgaccagttttccagccaccagtgggatgatggtatgtgccagcacatggtaattgtgggtgtaattctgacttgggcacaacagatgctatttgtgattttgggactggattccgatagggcctcctattatggggggggggtgaatgtgatgtatttggggggggctttgtataagr

SEQ ID NO: 44843 - DNA, 263 bp, Homo sapiens
cgtgctaagctagcgccgtcgtcgtctcccttcagtcgccatcatgattatctaccgggacctcatcagccacgatgagatgttctccgacatctacaagatccgggagatcgcggacgggttgtgcctcgaggtggaggggaagatggtcagtaggacagaaggtaacattgatgactcgctcattggtggcaatgcctcccctgaaggcccccagggcggaggtacccaaagacaataatgacatgggttcggtattttca

SEQ ID NO: 44844 - DNA, 193 bp, Homo sapiens
atgatgcatatgactctatactgtataattgtgtttcatttattggatgtatgagaacatattggcatacagcacatgcattagccaggcaattgggattacaaggtaggttgttcagatcagcgaaacattcagtctggtgcatgcctgcctggcgctatggtgtcaatctcgatgcaggttttgtgggggs

SEQ ID NO: 44845 - DNA, 276 bp, Homo sapiens
  misc_feature 225: n = A,T,C or G
ggttgagatgaagcttcttcatggagtaaaagatgtatttagctagagaattgagagagaggactacagagccccgaattaataccaatagaagggcaatgcttttagattagcatgaaggtgacttaaacagcttaggtttagtttaacagttgtaggtgattagtaatttgcaggcgatcttttcaaaagagattaaaccgaagtgaattaacagaccttganatccatgacgcagggagacttgcgtcatttacagcctagttaccgcatttc

SEQ ID NO: 44846 - DNA, 235 bp, Homo sapiens
gattattacatttacagtacttggatacttgtatcaactatgcagcgcttttacgatacagtgtgatatatttcatcagctaatgagactgactgggtgcaggtttttagcacgcgttagtatacttgcagatactacgacattttggtcatctttcttactaaaagatgtgtctgtttgatgtacctctctctgtttctactctgtagtccgvtggggattcagtgatgcacat

SEQ ID NO: 44847 - DNA, 170 bp, Homo sapiens
attgaagtcctgattgcagcagtgactctgcgaccttggataaattatttcaatctttattttgtaaaacggagataacggcctataggattgtgaagactgaatatttgggccgagcttagcatggtgcctgacatatgagagacaataaatactgattattggccatr

SEQ ID NO: 44848 - DNA, 283 bp, Homo sapiens
tcaacagaaagagctggagaaagtttgcaaccccatcatcaccaagctgtaccagagtgcaggaggcatgccaggaggaatgcctgggggatttcctggtggtggagctcctccctctggtggtgcttcctaagggcccaccattgaagaggttgattaagccaaccaagtgtagatgtagcattgttccacacatttaaaacatttgagggacctaaattcgtagcagattctgtggcagttttaaaaagttaagctgctatagtaagttactgggcattct

SEQ ID NO: 44849 - DNA, 214 bp, Homo sapiens
tgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcaaaaaar

SEQ ID NO: 44850 - DNA, 160 bp, Homo sapiens
  misc_feature 66: n = A,T,C or G
aaaacttggatacacaaagtgactaagaagctattatagcattgcatcctatatcaaacgtctganagagcacaaataaacaatctcagggtcacacctcacagaattggagtcactagaccagtccaaatccaaacccagcagcagggcaggactgaca

SEQ ID NO: 44851 - DNA, 239 bp, Homo sapiens
tgtatagcagtggctccagtctccagctgggaatattacgcgtctgtctacacagagagattcaatgggtctccaacagaggaaagataatctggagcacatataagaattccagcttgggggccaaagaccagaatattcgagagtttgagttatatctctcccatccaagggcacacaaagagtagttatatgtgctcatctcaaatctaagacgcagatactctagatctcgggtg

SEQ ID NO: 44852 - DNA, 214 bp, Homo sapiens
aaccatctgcgaggcctgaatctattccagttggattggcaataattgagccggcaggcattttaaatttctggtcggggagcattgtgcctttggcaaacaatcggtgtccaccgtggtggtggcctcttggccggggattgcctctctctttccctctcctattttttcccgttccgccctctctgggagccccgtcccgcgggttttgtct

SEQ ID NO: 44853 - DNA, 229 bp, Homo sapiens
gtgaccaggttgttgggtggatctcttgactgttaagccaagtaatttattctcttgacttctgtgatagataccaggagcaaagacatttaacttttcttacttcatttctgtagttccctttccttctactaaatgtgtgtctctggttgtgcgagagagatatatttatatcacacctgtgacacaaaagagttagagaataggagattatagagtgcccctctca

SEQ ID NO: 44854 - DNA, 112 bp, Homo sapiens
taccataaaagctgacacttgacatgtcaatgtatttgtccatttcattttaaactcggtatttgtgggttttttcccagataaaaatgaaattgaaccatttctttttgag

SEQ ID NO: 44855 - DNA, 144 bp, Homo sapiens
cttgacaagtatctctccatttgaccattatgaaaactatcattaagagagagaatttagattccttcttcctttgaaggaaaaaaggttcttttaattgtataaaacagcctcttatggtaatttggtataccatatgtttgt

SEQ ID NO: 44856 - DNA, 160 bp, Homo sapiens
ctgtcctggtccgcggcagagcccagcgcggctcgtcgccattccttggaaaatttagggaatcaagggcttccttcttacaggccggcggaaggatggccaaatctttcaaggtcaaggaaaataagggcaacgtgtagtgttaaaagtttcgagtgta

SEQ ID NO: 44857 - DNA, 237 bp, Homo sapiens
aaaaaaggtttgacttaacggtttgtattttcaggaatagaggtgtgctacagttcccggatatcatatttggcttgagggtcctgggttggacaattggaagagttaccaccaggataacttcttaatactaactctataatttattcactctcatatacacacatgggtgtttcacacacattatagtgtatgccctctttattgtcacaggcctctatctctaaagtgacccca

SEQ ID NO: 44858 - DNA, 201 bp, Homo sapiens
ttcttataaaaacctcacagccttccactaacatcccgtagagccctctctccctactgctgctacacaagaccctgagactgaccttcaggacggaaacatgaaggggctgatccctcttgccattcttggcggcttagggtagtaactttgtgtttatgaatcacatgagagcatgtggatctctatgagactctaata

SEQ ID NO: 44859 - DNA, 209 bp, Homo sapiens
aatcatgcaactactcagaatgtgtcctcctcatctaatgctcatctgtttaatggtgatgcctcgcgtacaggatctggttacctgtgcagttgtgaataaccagaggttgggcagatcagtgtctctagtcctacccagttttaaagttcatatgtgaagagtttgacctcatctccccgcaaataaattgtattggtgatttggag

SEQ ID NO: 44860 - DNA, 253 bp, Homo sapiens
atggtctagtaaggataacctttgttaggaaaaacaagacactctctgctgcatttaaatcaagtgcagtccaacaactcttggaaaaagaactacagattttcactgttcagtccataatattataataccagaggatttcagcatagcagataaaaatacagcaaatcctaaccagcacaggttttagtgacacacgggcccgttccatggacatagatgacttcatcagattgctacatggattcaacgc

SEQ ID NO: 44861 - DNA, 232 bp, Homo sapiens
aggaaaggagctctctgcactgagtgtctgtttagcctctccttctcagggctgctgctttaaaacaggttgtctgtttttgctgggggaattccataaatgaaaggtgtttgctgagagtctcatactaaatgacatgagagactcacaaaatatggagagagtagggaagccactgcaggtgttaatgggagttttacataatctagaggatcacttgagcccaggagtg

SEQ ID NO: 44862 - DNA, 251 bp, Homo sapiens
taaccacaatctaaatatttacatatacccaaaattaacttatgctcatatattaggatgtgagaatatcatctgtttatggacacatgaaacctcctaatgaccttgaattgttagaatatttgactttttatatgcaaagtttttcaaccaagtggtttgtctaatatttacacatgtactggcacaaatttgtgatgaaaatattagcacatttgcaataatgtttctccataacagagaatgttaat

SEQ ID NO: 44863 - DNA, 254 bp, Homo sapiens
ttgacatttccattataaactttaattttgaattgtttatgcattataactgtggatttatattgtattgggctgaaagttgacaggatttcagccaccacttgtgaatttttatttagattcattatgtatatcagaatcttgttttttgacataagagcatggaaaacatttcttgtaatctactcttgaacagaggatatttaggttttcacacagggttgtttgggcagctaatagtgtgacccagggca

SEQ ID NO: 44864 - DNA, 273 bp, Homo sapiens
ccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggttcatccatcccgccaatggaggtggccttaccttgaggattgaggagagatttagaaaaggtggagcatacagactggtctcacacgcagcgccctgggtctctctctctctgggcact

SEQ ID NO: 44865 - DNA, 263 bp, Homo sapiens
tataccacctgtacatacattgtataggccatctgtaaatatcccagagaacaatcactattcttaagcactttgaaaatatttctatgtaattattgtaactttttcaatggttgggacaatggcaataggacaaaacgggttactaagatgaaattgccaaaaaaattttataaacttattttgtccggatgaatgatatctttgagcccacatggggggtgtgcacaagggcccggtgtttcacactcactgtacacata

SEQ ID NO: 44866 - DNA, 265 bp, Homo sapiens
  misc_feature 233: n = A,T,C or G
agatcgcggacgggttgtgcctggaggtggaggggaagatggtcagtaggacagaaggtaacattgatgactcgctcattggtggaaatgcctccgctgaaggccccgagggcgaaggtacccaaagcacaataatcactggtgtcgatattgtcatgaaccatcacctgcaggaaacaagtttcacaaaagaagcctacaagaagtacatcaaagattacatgagatcaatncaaagggaaacttgaagaacagagaccagagc

SEQ ID NO: 44867 - DNA, 266 bp, Homo sapiens
  misc_feature 235: n = A,T,C or G
ccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcangcaaggactggtctttctatctcttgtacta

SEQ ID NO: 44868 - DNA, 243 bp, Homo sapiens
  misc_feature 212: n = A,T,C or G
aacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatggtcctccaaaaagtgcacttgtaccagtgacaagaagtcacttngtatagtgaccaagtacacataaaatactgg

SEQ ID NO: 44869 - DNA, 380 bp, Homo sapiens
gttggcacttcatgggtttcaggttttagagcattttgaattttagatttttgaactatactcaacctgtatataaaaatacacagtaaaaattgaactgagaattaagcatcattaaacattttcaaacattaatttatttaaatgtggagatggaaatgtttcatttatctatttattttttaagaaatctggagtggatgatggggagttctcattatgttgccctggctggtcttgaacccctgagctcaagcgattctctcgattctctcatgtagctggggctacaggcaggtgccactgtgcaaacaaaatttgttttaaaagcatgcttattcaaacctggaaggtacttctctttttttttttttttttaa

SEQ ID NO: 44870 - DNA, 319 bp, Homo sapiens
atccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtcgaaaaaaaaaaaaaaaaaaa

SEQ ID NO: 44871 - DNA, 525 bp, Homo sapiens
tctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaa

SEQ ID NO: 44872 - DNA, 500 bp, Homo sapiens
attgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccgttatttataatcagggtagcattaaaatggagaaaagaaagttttctgaaaaaatgcagtaaatataagccacatttctaaagtttatttttatgaaagcttcttttaagattttgaaatctattctgcattccca

SEQ ID NO: 44873 - DNA, 247 bp, Homo sapiens
atcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaattggagctttggaagtaattttgtgtcttctggtatacagacca

SEQ ID NO: 44874 - DNA, 216 bp, Homo sapiens
catttatcagtgttcatagtaatgagttggtttcttagcaaccgccactgttttctttaatatcattaagaattcatggattttcatgtatttcccgtgtatcaacccattgtggtcattttttaatgcttaaacagtgtcatcttataacttaggagccccttctgttttcacttctatggtttttccctcacattatctccttaggctttgttt

SEQ ID NO: 44875 - DNA, 209 bp, Homo sapiens
aacaagaagcgggtgctcaccctccgcaagtccttgctggtgcagacgaagcggcgggctctggagaagattgactttaaggtcattgacaccacctccaaggtttggccattggccggttccaggcccttgaggagaaggaagggtttatgggacccttaaggaagagcccaatttcaaagggaggaggggctctatgtcaagcacac

SEQ ID NO: 44876 - DNA, 227 bp, Homo sapiens
  misc_feature 196: n = A,T,C or G
tctcactgctcacctgaggataactcaatataactatgttgctgaaaatgcaaagctgaagaccatggattccatggtgattccagcaagtacagagattctatgaagcccacccagaaaaaaacttgctggtcctggctatttttgtgtcatttattcaaggattgagaacctggcctttggaagggactttatnttaatactggggtacagagattaaaaaggtt

SEQ ID NO: 44877 - DNA, 122 bp, Homo sapiens
ctcctcgaactcctatgccattaagaagaaggacgagctggagcgtgtggccaagtccaaccgctgattttcccagctgctgcccaataaacctgtctgccctttggggcagttccaagcca

SEQ ID NO: 44878 - DNA, 253 bp, Homo sapiens
aaaaaagccattaagaaggaaaggcaaaaacttcgaaactcatgcaagacctggaatcatttttctgataatgaggcagagcgggttaaaatgatggaagaagttgaaaaactttgttgatcggcttgtaactggcaagcttacagttcttgaattaaacactcacattcatgcacacacggagtagggaagggctgtcttttgggaacacagatatagagggatatatttagcgcactcagagaagagagag

SEQ ID NO: 44879 - DNA, 272 bp, Homo sapiens
tctgcttcgaagtattcaataccgctcagtattttaaatgaagtgattctaagatttggtttgggatcaataggaaagcatatgcagccaaccaagatgcaaatgttttggaatgatatgaccaaaattttaagtaggagagtcacccaaacatttctgctttcacattaagtgtctggcccccaatacctgtagggcaaggatgatcctggttaccttgatattttaaatatccccggggctcaactttttacccaatgtctcccgggaga

SEQ ID NO: 44880 - DNA, 211 bp, Homo sapiens
aaccataaccaatactaccaatcaatactcatcattaataatcataatggctatagcaataaaactagggaatagaacccctttgcacttctggagtccccagaggttacccaagggcacccctcgtgaacgattccggcctgctttcttcttcacagggacaaagacttagagccccttctaaaataaatatacccggagttcttcccca

SEQ ID NO: 44881 - DNA, 232 bp, Homo sapiens
ccttacctgaatcagtcctttttggttggtaatagatttttttatacacccacgtttgatttaaaagtaaattctagttcttaagcacttttaacaaggaatccagaagcacatttttcttgcacaaacaagttacaaagttcaaaagtgtttctggttgcattgtggtttgagggttcagtgtctttaactctgtaaaaccacactctgcggagaacttgtcactctctgt

SEQ ID NO: 44882 - DNA, 218 bp, Homo sapiens
tgggctgttacttgctttgagttggaagcggtttgcatttacgcctgtaaatgtattcattcttaatttatgtaagggtttttttgtacgcaattctcgattctttgaagagatgacaacaaatttttggttttctacttgttattgtgagaacattaggccccagcaacacgtcattgtgtaaggagaaataaaagtgtctgccgtataccaaatat

SEQ ID NO: 44883 - DNA, 212 bp, Homo sapiens
cacttaaccaaccaatcagaacaccacatctgttaggggaggtaacctggccaacagtgtatccatcacgttagccctgctggtagggaagggacccacattcaactcgccctcttgacctggccccttggatcccatatctatttaccgtgtgccatagggtataattaggtaacggggccctgttctcgtggtgcgaaggcatgtataca

SEQ ID NO: 44884 - DNA, 181 bp, Homo sapiens
ggttcacagcgtgcagagtgtgggaggcaggtcacagttgccgagtcaaggtatgtttttccgtgcgccaccacttttcgagggggcagttcgactttgttcatggcctttgttgtggtagcagtttgtaactagctagttgactcgagggggggtttttggccttggttcttttgcggtg

SEQ ID NO: 44885 - DNA, 278 bp, Homo sapiens
acgcccccaaggacatctggaatgtcactggtgcccaggtgtacttgagctgtgaggtcatcggaatcccgacacctgtcctcatctggaacaaggtaaaaaggggtcactattgagttcaaaggacagaacttcttccttgtgacccggacaaccttgccattcagacccagggttgtccagaaaagcatgtaagtagcttgctctggtgcttggatctcctctctagtgagggagatactctgagagtatatagtgtcacacataccactattccc

SEQ ID NO: 44886 - DNA, 202 bp, Homo sapiens
tatgtctggctgtagctgttggtcacgtgaagatgacagacgatgagcttgtgtataacattcacctggctgtcaacttcttgggggtcattgctcaaggaaaacttgcaggatgtccgggccttatatatcaagggcaccatgggcaagccccagcgcctatattaaggcacatattgtatataattctatttccccgaga

SEQ ID NO: 44887 - DNA, 221 bp, Homo sapiens
aagagcagaatatttcggaaatgtagactatcttctcatccacggaacaacagatgataatgtgcactttcaaaactcagcacagattgctaaagctcttggtaatgcacaagtggtttttcaggcaatgtggtactcttgaccaggaccacgggcttattctggctgtctcacgggaccacttatacacaccacatgtacccacttttctatagggagak

SEQ ID NO: 44888 - DNA, 146 bp, Homo sapiens
gaagagagagactacctccacatcaagaatatttaagttattatctcaaacagtgacatctcttgggaaaatggacttaataggaatatgggacttagttccaatcttttttaataaaataaaatcaagcaaaatcacatattctt

SEQ ID NO: 44889 - DNA, 274 bp, Homo sapiens
cagcgcaatcctattctagagtccatatcaacaatagggtttacgacctcgatgttggatcaggacatcccgatggtgcagccgctattaaaggttcgtttgttcaacgattaaagtcctacgtgatctgagttcagacccgagtaatccagggcgggttctatctacttcaaaactctccctgtacgagaaggacacagagatattaggcttcttcacagagcgtcttcccccgtataatgatatcatatcacctctagtattatatccccac

SEQ ID NO: 44890 - DNA, 177 bp, Homo sapiens
gggaggcatatcatacaaagagaatgcaacatgttatctgtgtaaaatggacttctgacagcaagtatattatgtgtggatctgatgaaatgaacattcgcctgtggaaagctaatgcttctgacaaattgggtgtgcttacatcacgagaaaaagcagccaaggattatgacccaa

SEQ ID NO: 44891 - DNA, 279 bp, Homo sapiens
gcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgttttcattgaggtgcagagggagagtcttaccgggcctacgtatctcttaccacgatggcgcttacctttcagacttcattaaacttatgacccaaaaaaaaaaaaaaaggaaacaa

SEQ ID NO: 44892 - DNA, 128 bp, Homo sapiens
tcttctaaaaaacactcatactttcaagttcaatttcaacctttcccctttcaaacttttttcaaacaaaaatcctaaatatcgcttgcttcctggccccccgccgttttaaataaacgctgttcctt

SEQ ID NO: 44893 - DNA, 236 bp, Homo sapiens
caccatactgagaaaagtgcaaaggtatggcttctcagcagatatttattgttaatttatagtttttggtctaggtgccaacttatgagttaacagtcaataataactgaaatattatgagtaacccaccaaattttcatatagtgtgcatcatgatgcttatgttcaggggtagcctgtcattttattttcagtacctgtgagtgaaccttcctatttctcatagcttttgcagg

SEQ ID NO: 44894 - DNA, 237 bp, Homo sapiens
aaatctttgtaaaactcatgacttaaccaatgagcactggcaaagagtgcaagttcattaaattcattgtcttctatttccacaatatattttcctttggagacagatcctctctctattgcccaggatgaaagcgcagtggcaaaatcacggctcactgcagcctcgaactctggggctcaggtgatcctcccccctcagactccagagtagctgggactacaggcatgtgccacc

SEQ ID NO: 44895 - DNA, 230 bp, Homo sapiens
ccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaccccagg

SEQ ID NO: 44896 - DNA, 233 bp, Homo sapiens
ccagccgggctggcgctgtgacaactgccggagacctgggggtgcaacccagtcccgaagggattaatgggcaagtcctacaacagtattctaagagcataccattagagcaacaaagactaatgtttaattgcacaaattgagctccttaatgcgctttagaatgtacagggtgacagagcaagaattccgagagtaaatcatctttctcaattcagaggaacaggatgtct

SEQ ID NO: 44897 - DNA, 225 bp, Homo sapiens
ctcctgcccctcctaaagctgaagccaaagcgaaggctttaaaggccaagaaggcagttttgaaaggtgtccacagccacaaaaagaagaagatccgcacgtcacccaccttccggcggccgaagacacttcgactccggagacagcccaaatatcctcggaagagcgctcccaggagaaacaagcttgaccactatgctatcatcaagtttccgctgaccactg

SEQ ID NO: 44898 - DNA, 242 bp, Homo sapiens
tggttgtgtggtagcgtctcggaaaccggtagcgcttgcagcatggctgaccaactgacttaagagcaggattgcaggattcaagggggtttttcactatttggacaaaggatgggggatgggaactataacaacaaggggattggggactgtaatggggtctcttggggcaggttcccacagaggcgggggttacaggggcatgattaatgggggggttgctgatggggatggcacatttg

SEQ ID NO: 44899 - DNA, 236 bp, Homo sapiens
atattttaaatatccacagtactcactttttccaaatgatcctagtaattgcctagaaatatctttctcttacctgttatttatcaatttttcccagtatttttatacggaaaaaatttgtattgaaaacacttaggatgcagttgataagaggaattttggtataattatgggggggtgattattttttatactgtatgtgccaaagctttactactggtgaaggcaactgtttt

SEQ ID NO: 44900 - DNA, 238 bp, Homo sapiens
tcttgaagctctgtttggtgctttggatccatttccatcggtccttacagccgctcgtcagacttcagcagccaagatggtgaagcagatcgagagcaagacttcttttcagggagccttggaccgctgcaggtgataaacttgttagtagttgacttctcagccacgtggtgtgggcccttgcaaaatgatcaagcctttctttcattccctctctgaaaagtattccacgtgatat

SEQ ID NO: 44901 - DNA, 239 bp, Homo sapiens
ttttcctataacctactccagtgtgctacatggaaacattgacctgtacccatgtttgtatagctgttagattttgggttttgtctgacaatttactaagccctttactcttagagttgctaggcaagagaatattcctgtggcatttgtgttgagcatgaacataagattggcaaagtgaatctgaagtggaatcttctaatttggagtggggtaatgactcttggattattaaggct

SEQ ID NO: 44902 - DNA, 239 bp, Homo sapiens
ttttgcccacctctgcaatagtgataatctgatgctgaagatcaaataaccaatataaagcatatttcttggccttgctccacaggacataggcaagccttgatcatagttcatacatataaatggtggtgtaaataaagagatataaacacaaatacttttacttgaaatgtaaatatacctttttatttctctggctatatgtggggttctatgtgcacattctactgtgtttgcgc

SEQ ID NO: 44903 - DNA, 243 bp, Homo sapiens
ccccatgacacacctattagaatggtctaaatccaaaacgctgacagcaaatgctgggtgagggtgtgaagccatggggactctcattcattgctgggggggtatacaaaatgggacagccatcttgggacatcagtttgggaggtttcttacacaaaccagagcatatttaccctatgatctcggggtgtgtgtctcctcagggtttatacacacgggtggggctctacacgatacacacga

SEQ ID NO: 44904 - DNA, 237 bp, Homo sapiens
aaggagcttgtcatatagtcacttgtgttggacccttgaattggctcacctcactgtcctcgtacagtgatcacttcaaagaggcacggtgtttcacttgaatacacccaggggcccatctatctaatgcctctaggtcttacatcctcctcccttaaaaattaaggtgtctctcacaaactgtttttgtgggctgcatctggggtttagggaagcgcgcgttcccaacaatgttct

SEQ ID NO: 44905 - DNA, 237 bp, Homo sapiens
agcctttccctagcagtggaacgctgtggtcattttctctagcatattcccttgggaagtctagatttgctattaatctggctgagaatctaagttctgtgccttagagacagtttgcactttcccatattgtgccttggacagccatatgattttttttcccaccaaacaagtattcaaacagaggaccagttcaaaggggggtgtgagttaaagataagggcaatagagatgtcc

SEQ ID NO: 44906 - DNA, 111 bp, Homo sapiens
aatactttgtaaaaggtattttggggactattaaaactgctttttttttttccagcaagttatccaaccaactggggttctgcttcaataaatttttggaaaaacttaaaa

SEQ ID NO: 44907 - DNA, 165 bp, Homo sapiens
gcccggtgagcccgaggagaggaagtcccttaagctcctaggatttttagatgttgaaaaaaaaacaaaaaaaaaaaaaaaaaaaaaatttgggcccctttggcccatttggttttaggtttgggaaagatttattaattggggcaaaatttggggtttatttgg

SEQ ID NO: 44908 - DNA, 140 bp, Homo sapiens
ctggagtgttggtctcctagggaccaaggcctttgcatttttttctaccctgacttccaacttctaatttctcctttaatggtaataataataatatctgctgctaatgtaataattttaaggtaattaaagggttttgg

SEQ ID NO: 44909 - DNA, 253 bp, Homo sapiens
tcgcaccatatggaaatgttgaaaactattgtaaagtagtattatgaagtagcttttgtgtcaatcatgtcgatgacatgaaagtgaagtaaatttattctatgtaaattcacactaaaacccgtacaggccccttaggtggttccatgtttaggctcacctctgtctttcactatatatgagtgaaatatacacacggctttatttttacacatagagagtctctactcttacatcccctacccccatatct

SEQ ID NO: 44910 - DNA, 216 bp, Homo sapiens
aaaaaggaaaaagctgcaaaaacagccttgaatagtttcatgcattccaaagaaggaacagcaggggaaaaaggcttattccccagggtaaagggcacaggttttttccagggcccttcctgggccccgggaaagtgtcttcaccccatcttcttagacgttaaaaggggattgctctggagtgggattttttaaatacttttgtagaagggcccc

SEQ ID NO: 44911 - DNA, 128 bp, Homo sapiens
atctttaatctggttatggctcaaaatgccgcccttttatattttcaacttttttctcttattacttttgccttttatccctcgggcaacccctttttttaatcccctttatatctgttattttttam

SEQ ID NO: 44912 - DNA, 311 bp, Homo sapiens
cccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctgggcaaaatcttgttaatgtcattgctaaaagataaataaaagctagatactgggagaccttactcgcaatgtggatgttttacccacatgacttattatgcataaagccaaatttccagtttaagtgattgtcaaaaa

SEQ ID NO: 44913 - DNA, 156 bp, Homo sapiens
ctgcaaaattaaatctagacattcttttaatgccaccacacgtgttccgcttctctcttttaaagtatttataaaaatataaattgtacattttgtaaaatattatgtttgatttctctacttgtcatatcactaaataaacacggttttattgca

SEQ ID NO: 44914 - DNA, 250 bp, Homo sapiens
aacaagcggctgccagaaaggaggattatttacgccatgagatcggtgaacttcagcagagactccaggaagcagagaatcgaaaccaggaacttgagtcaaagtgtttcatcaacaacaagaccatttcttcgacaaatagaaaatttgcaagcaaccctagggatcccagacatacgtcgtggggagaaaatagagagagaaatctccactctatagggcttaagtgagtgaacacgacactaatttg

SEQ ID NO: 44915 - DNA, 282 bp, Homo sapiens
acttttaccattcctattccgcatagtactagaagttctaaccaaagcagtcaggcaagaacaagatataaaaggcacccaaatcagaaaagaggaagtcagattagtccctctttgtagatgacgtgatcttatatagagaaaaaccttaagacttctccaagaaaagtcttagaacttataaagtaattcagtaaagtttcaagagcacaaaatctcaacactgtgaaagtcagtatgcactttatatacaccacataattgaactatgcgggagatatc

SEQ ID NO: 44916 - DNA, 281 bp, Homo sapiens
ttctgctgagggggcaggcggacttgaggaaaccgcagataagtttttttctctttgaaagatagagattaatacaactacttaaaaaatatagtcaataggttactaagatattggcttagcgttaagtttttaacgtaattttaatagcttaagattttaagagaaaatatgaagacttagaagagtagcatgaggaaggaaaagataaaaggtttctaaaacatagacgggaggttgagatgaagcttctatcatgggagtaaaaaaatgtattttca

SEQ ID NO: 44917 - DNA, 362 bp, Homo sapiens
tatgaccaaaattttaagtaggaaagtcacccaaacacttctgctttcacttaagtgtctggcccgcaatactgtaggaacaagcatgatcttgttactgtgatattttaaatatccacagtactaactttttccaaatgatcctagtaattgcctagaaatatctttctcttacctgttatttatcaatttttcccagtatttttatacggaaaaaattgtattgaaaacacttaggatgcagttgataagaggaatttgggataattatgtgtgggggattattttttatactgtatgtgccaaagctttcctactgtggaaagacaactgttttaataaaagtttacatttcaataata

SEQ ID NO: 44918 - DNA, 311 bp, Homo sapiens
aatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaaggttgtgattcagcctctacttaaggttgtcatccgtggagcaggaaaccagtacaattacatttgctattcttgactataaaaaggagagggattcgtgaagctttcccctgaaagccagcacttcctcacatctatcccctgggtgtt

SEQ ID NO: 44919 - DNA, 310 bp, Homo sapiens
ccgagatgtctcgctccgtggccttagctgtgctcgcgctactctctctttctggcctggaggctatccagcgtactccaaagattcaggtttactcacgtcatccagcagagaattgaaagtcaaatttcctgaattgctatgtgtcttgggttcatccatccgacattgaaggtgacttactgaagaattgagagagaattgaaaaagttgagcaatcagacttgtctttcagcaaggactggtctttctatctctttgtacatacactcaattcacccccactccaaaaaagaggggtagtatttct

SEQ ID NO: 44920 - DNA, 212 bp, Homo sapiens
tctcgggctagtcatggcgtccccgtctcggagactgcagactaaaccagtcattacttgtttcaagagcgttctgctaatctacaattttattttctggatcactggcgttatccttcttgcagtttgcattttgggcaaggtgagccttgaggattacttttctcttttaaatgagaaggccaccaatgtccccctcgtgctctatatgc

SEQ ID NO: 44921 - DNA, 210 bp, Homo sapiens
acacacaccaaaaaggatttttttttggggtagctttttagcaacccggcccagaacctggagaccagccactcacccttagaggtgtctatgggggccctgtcaattaacccggaaaccatatggaaagttcaagaaagcccccaaatttataccccggcaaaaacttttaaagtcaagttaaaaaaaaaaaaaaagccaggcacccgg

SEQ ID NO: 44922 - DNA, 268 bp, Homo sapiens
ctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcatttggaggccaccccttttttttacatttcatacaccagaaaccagagaagcagtacttgtttccactttagggg

SEQ ID NO: 44923 - DNA, 182 bp, Homo sapiens
taactaccgtctttttgctaggacttaaactgacttgagtgtggcaaaaagttaacaaaaaaggagaaaaaatgaacaatcgtttgtggtttcttggggaaaacttttcataccagggtgatactattcaaaaaccccgttgtctccctgcaagtgctgatttgaaatgcagtagccacagt

SEQ ID NO: 44924 - DNA, 259 bp, Homo sapiens
gggcgagcagcggcgcgcaaggaaagatcgggttccgtttttcccgcggattctggtgcctgtggggccggtgacccaacaccatgaaggaaatggcactctcaaactgcgaacgccgcttcctactccgtgccatcgaagagaagaagcggctcgatggcagacaaacctatgattataggaacatcaggatctcatttggaacagattacgcgatgctgcattatggaactctggaaaaacaagagattcttggagc

SEQ ID NO: 44925 - DNA, 319 bp, Homo sapiens
ttgctggatcatacagaaatttgatttttgattttttgaggaattagcagacttatcttcgtagcagctataccaccatcagagtactcaggttccaattgtcttttgacttttaaaccagtccatcttgtcaatttatttaattttgccacaagttctagtaggtggcaggaaagcccatttgaaaattttgatgcagataaacagttcttttctgatatactcagggtcagagggtcagattcactttctgataaacttaccacttgtgtggcacagacacccagagtgttagagttagagtctcttgagcaaacts

SEQ ID NO: 44926 - DNA, 228 bp, Homo sapiens
tgggaaaggaggacctgcaaccatctgacttggtctctgttaatgacgtctctccctctaaaccccattaaggactgggagaggcagagcaagcctcagagcccaggcctcagtcggtcaattaagatggttaaggctttttgcggccagattcctgggtgatttgaatcaataaaggggkaatttctttcctaaataaataaaaggaacccttgttggaaaacctaa

SEQ ID NO: 44927 - DNA, 216 bp, Homo sapiens
taaccacatggctaccttctatcctctgttcccaaatggtggtggcacttatcctgaagtcgtcaatgatttccctttgaaactactttattttactaatttaaactattttgtactgatgtagacctgaggtagcttcatgaaaatgctgtgcactggagtccatgggatcaatgttgggaaggtggatcctttctgatataaaaaggttggatk

SEQ ID NO: 44928 - DNA, 134 bp, Homo sapiens
aaaacttgaaaactgtgcttttaattgaaataatattggatgaatgaaactgaattcagtattaaaatttgactgttagaaatgaaaaataaaatgatttaaaaatttaaaaaaaaaaaaaaaaaaaatadmrt

SEQ ID NO: 44929 - DNA, 232 bp, Homo sapiens
ggtggtcatgggcatcccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgaggctccaggatcagcaggttcctgacgcagtcaaaggggtaccgattggtgggctattattat

SEQ ID NO: 44930 - DNA, 270 bp, Homo sapiens
cacattctaatgatgtatatatggagtggctcaatcatagtgaagaattaagagaaagtcaattgtattggcatttttaataagaacaaaattagttcgtctaaggggacttgctcggccacatatttgttccttgcccatatgctttctacctcttggtcttattatgaaattatgaatttgaggcccttaaattgggatcagttttcaacatctttcaaaaacaaaattactatttccccacattgccctgtgtgggaactctatagg

SEQ ID NO: 44931 - DNA, 146 bp, Homo sapiens
ctttttgtgctccttgctttgcttatctctcgcttgctctcagtggtataatgcacattgcatctatgtttagagaacagtatttattatataagtctgaatattgtatccgttaaaaagggcagactcagtgttgcgtagtgtgc

SEQ ID NO: 44932 - DNA, 191 bp, Homo sapiens
gacacatgagataagtaaggaaagaaagaagctagagcaagatagagaagagatgcaatatcaacatattcaacaatatcatggataatatagcaagcaaaccaagctagacacaatcaaaggatatagaggcttaaagatccatgtatgactccaaagccgaaatttatgtatatatatggagagtatag

SEQ ID NO: 44933 - DNA, 208 bp, Homo sapiens
atgaggaagattgtcttaaactataatgttatggattaatgattcaggatgaatggaatctggtaatgggagcacaaaggtaaatcttcctttcgataccaccacctatgtgacacgaatcaatataataacggtcaacgcttgagggatcataggtcaaagggcttgatagacaagtggatagacattcccgatatatcctgtatat

SEQ ID NO: 44934 - DNA, 243 bp, Homo sapiens
ggtgagagatcaacagaaagtgcaagttattcccatcttcaagtgttgaattctggaggaagaagacacattcctagttccccgtgaacttcctttgacttattgtcccaactaaaataaaataaaaaacttttaatgtccttcaacaattaatgagatttgcttgcagtttttttatggcattttttcgaagagtgccctcagtgttgtgagcagagtttgcaaatgcaacaaaatcttttm

SEQ ID NO: 44935 - DNA, 147 bp, Homo sapiens
tgatggaaacacatgagcagtaacaagttttaatactagctcctcagtactaacatggactaatctgtgggagcagtttattccagtatcacccagggagcagccacaccaggactatttgagggggatttattaatacgctataaa

SEQ ID NO: 44936 - DNA, 215 bp, Homo sapiens
ttgaggcagccagcgcaggggcttctgctgagggggcaggcggacttcgaggaaaccgcagataagtttttttctctttgaaagatagagattaatacaactacttaaaaaatatagtcaataggttactaagatattgcttagcggtaagctttaaacagtaattttaatagcttaagattttaagaggaatattgaggtcttagcagtgtagc

SEQ ID NO: 44937 - DNA, 199 bp, Homo sapiens
aaaaatcataatagtagtattagagtagtgtaataatccattttattctattttctacagtttctgtaatatatatatcttaggaattaaatactaataaacgcattatagaatatgagtgttattagtgatctcaaattgacagatgaccacggtgtagttcatataagaacaataaagcccgattcgtcattatttc

SEQ ID NO: 44938 - DNA, 141 bp, Homo sapiens
cagtcagatctaacaggttctgttgagccagaatctgtttcagatccaagatggagaggcacactatggatactcaccaggtgactacacacgagcagttgttttacaacacatcacatgtgtctctcagtggactccacg

SEQ ID NO: 44939 - DNA, 203 bp, Homo sapiens
ctcggtggtggccactgcgcagaccagacttcgctcgtactcgtgcgcctcgcttcgcttttactccgcaaccatgtctgcacacacccgtatatggctgagatcgaggaattcggtaaggcgaaactctgagaaggacagaacacggaagaataaaaatgcctcttaccgtatccaaggaaacgattttgacacagagaacg

SEQ ID NO: 44940 - DNA, 237 bp, Homo sapiens
tgacttgatccgcagactatggagacccgttggacaggaacataggggatagtagccaaccctatcaaaatgaggactatctaaccatcatgattgccatcatcgccggtgccatagggggtccaatgttgtggatcttcgtgcaacgttgtgtgtgcgcttgtccgccmwrccwwcaarggttcaargsrgayccavagggggcagacaggtgcccacataggtgtccccccaacc

SEQ ID NO: 44941 - DNA, 214 bp, Homo sapiens
cattggaagccatccctttttttacatttcatacaacagaaaccagaaaagcaatactgtttccattttaaggatatgattaatattattaatataccggtgatgatgatgatgatgaaactaaggaatttttcaagagatctttctttccgaaacatttcttggacagtacctgattgtattttttttttaaataaaagcacaaggtcttttg

SEQ ID NO: 44942 - DNA, 368 bp, Homo sapiens
ttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcacttggagtcttatggaaagagataaagcgcatctctttgagttgatctggtacatatatgtcaaagggttttgagaacatataaattaaggagcatatttctctatttatgagaaaaatatctcaaatatatgccatttatccctctttatgaagggtacagagtattttatagcagcgaaaaattgtatttagagcggtatataaatatat

SEQ ID NO: 44943 - DNA, 283 bp, Homo sapiens
aattctccagtgaccgaacaattaaagaatatgcccaaaacatctggaacgtggaaaccttcagatctaaagatttctctatccaatgaatctaacaaagtcaatggaaattgactctggatttgtctctggaaacatagcttcttactgacttgacatttttcaccatcactggttttgtttggtagcgaaaatctctaaaggggtgagtctctctggcaatggggaggaaatttaatgtaagagagctctaaaataaagtgtcaatctccagggctatata

SEQ ID NO: 44944 - DNA, 410 bp, Homo sapiens
gtcggtcgctgcagcgatctcccatggccgcgtatttcgccgtatgggcctcggtcccgagtcccgcatccatctgttgcggaacttgctcacagggctggtgcggcacggacggatcgaggcaccaggggcgcgtgttgacgaaatgaggggctacgcggagaagctcatcgactattggaagctgggagacactaacgcaacgagccatgggcacttgctaactctctggctcacagagaaggattttataccccaagctttctcacaaaactctcccctctgaacacagagcacactttggggctactacacaaattctgcagaaccccaaatcgtggttgtgtgcgcgccacgagtagtggcatgataatggggtaaaagggttgcctcctccacccgcgtcttcc

SEQ ID NO: 44945 - DNA, 235 bp, Homo sapiens
actgaaaactcaggagctggcatcaaactcgtagtcccatagtcagtgttaattacacacattgttaactattggatgaaaaatacatgctattgattgtgtcccaaggctcccgagggcctccgtggggatgctcttgtgagccttgaatacagggactctaggtgtaaagtccccaacctctgagattttccagtgggtgaagtgtgggagaaaccaaatgtctctcgtgtct

SEQ ID NO: 44946 - DNA, 140 bp, Homo sapiens
tatgcacttgattaacttataaaatgttagaggaaactttcacatgaataatttttgtcaaattttatcatggtataatttgttaaaattaaaaggaatttcaaaaggaaaaaaaatataaagaaagcgggcttatacaa

SEQ ID NO: 44947 - DNA, 411 bp, Homo sapiens
ccaaaagccaaaatgaaactgatggtacttgttttcaccattgggctaactttgctgctaggagttcaagccatgcctgcaaatcgcctctcttgctacagaagatactaaaggtcacaactgtcaccaaccttccggagggagtgagctgccctgaaaagggttgttgtcaatgtccgggttcattctggtgtgggaagggttgtaagatggctctgtcactgcacttagagcgaatcgctctctgccaaagagcgttttcttgggccaagagatctctcccgggatccctcgcacactcagtgagactctccaggtatccgagagaccccatccctgatccccacacactgcactacatcaggtatactccatttcgggtttctatatgaacaatagaccatagattct

SEQ ID NO: 44948 - DNA, 415 bp, Homo sapiens
tcctacgtgtatgaactcagcgcagtcctcatacacagaggagtgagtgcttattctggccactacatcgcccacgtgaaagatccacagtctggtgaatggtataaggttaatgatgaaggcatagaaaaggtggaggggaggaatttacactagggtttaaggaaggtcttagaaagaccctcttaaggtaaagaaacgaaacccaaggtttggaaaggacctcattccctctgggaattgtatatatgttgggttataggctccacactcaggaaaggccaacactacctgttcaggtccacctttgcttcaggggctgggaggtcgggataattccaacttctgtggggggggtgattaaaatcgctacatcctaacaaagggtcgaaaagagtcgatacacggcgggtaa

SEQ ID NO: 44949 - DNA, 117 bp, Homo sapiens
catggtggcgcatgcccttagtcccaggtactcgggaggctgaggcaagagaatcacttgaacccaggaggtggaggtttcagttagccgagatttcacatttcaattcaggcttgg

SEQ ID NO: 44950 - DNA, 211 bp, Homo sapiens
aaaactgtcatttcaggttctgtgctctttttggagtctttaagctcagtattagtctattgcagctatctcgttttcatgctaaaataggttttggtgatcttgtctcttattttggacaaacatcaataaatgcttacttgtatataggggtaataaaccccttaccccaggaagaaaagatagaacacgaagaaagcagactgtggag

SEQ ID NO: 44951 - DNA, 198 bp, Homo sapiens
ttgaggcagccagcgcaggggcttctgctgaggggcaggcggacttggaggaaccgcagataagtttttttctccctgcaaagtaagaggttaatacagctacgtaaaaagtataggcggtagggcaccagaggtattgaatacggcgcaacggttttaaccgaattttactaggtcactgttttaacggcgaatata

SEQ ID NO: 44952 - DNA, 229 bp, Homo sapiens
catttaggcagccagcgcaggggcttctgctgaggggacaggcggacttgaggaaaccgcagataagtttttttctcttggaaggatagagattaatacactacttaaaaaatatggccaataggttactacgaatattgccttagcgttaagtttttaccgtaaattttaatagcttaagattttacgagaaaatatgacgacttagaagagtagcatgtaggaagga

SEQ ID NO: 44953 - DNA, 165 bp, Homo sapiens
ggtttactggtaaattatgttattttttacaactaattttgtactctcagaatgtttgtgcatatgcttcttgcaatgcatattttttgctctccaatcggtttcaataaagccatttgcacagatatacaagagagcttacttgcagaattggagtaattcaga

SEQ ID NO: 44954 - DNA, 346 bp, Homo sapiens
  misc_feature 346: n = A,T,C or G
gcaaggtcaccaagtcggcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaaaaaaaaaaan

SEQ ID NO: 44955 - DNA, 443 bp, Homo sapiens
cattttcattttgaaaatcggcaaattttaaacttggcctgtgtaaagtaaaagttaaatcatccacggcagggtgtaggaagatttgttttaaggaatccagtgatacaggtttgattacaaagtttgaactgttaattgtttaacaatttgagacttggggctttctttctttggtttatttgtttttgcttttacccctaggcaacactagtttgccaggtagcaattgcactgtgcaatattacaatagggacggggaaaattttatggatgtaatgtctattacggtttgcgatagtatttctctctagttcccagtgatttaaatgtgaccaagccttctgtactttgtcacaaaaagcgggttttccaggtgactattttggggagtgtcaaaataagaatttagggggtattacgggtcgattcactttgaatta

SEQ ID NO: 44956 - DNA, 520 bp, Homo sapiens
accacacactgctcgagcactcgtgcgcctgggcccggttgtcctccgcaaccattgggtgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccggcaatatgcactgtacattccacaagcattgccttcttattttacttcttttaagctggttaactttgtaagatgcaaagaggttggatcaagttaaatgactgggctgccctttcacatcaaagaactactgcaacgaaggcgggcctgcctttcccatctgtctatctatctggctggcagggaagggaaagaacttgcatgttggtgaaggaagaaggggggtggaagaaggggggggggacgcagggaaatctagagaaaaccagctggccaaggtggcctgcaggctggaatgcagttaaacaagagtgcca

SEQ ID NO: 44957 - DNA, 531 bp, Homo sapiens
ctggtgaggatgtgaagcaatgggaactctcattcattgctggtgggaatacaaaatggtacagccactatggaacatcagtttggtagtttcttacaaaaccagacattcttaccatatgatctagcagttgtgctccttggtatttatccacaggagttgaaaacttacatccacacgaaaatctgagcatgaatgtttattcataattgcctgtcatatatagtcagtagattttaacaaaggcttcaaagataaatcaatggtgatagaataatattttaaaaaatggtgctggatggaccaattcctggaaagacacaattcatccaggtgcagtggctcatgcctgtaatcccagcaatttgggaggcagagacgggtggatcacctgaggtcaggagttcaagacctgcctgaccaacatggcaaaaccctatcaactaaaaatacaaaaatcagctgggtgtggtggtgtgcacctatggtccagatactcgggaggctgagacaggagaatcgcttgaacct

SEQ ID NO: 44958 - DNA, 201 bp, Homo sapiens
agataaatttaaacctgaaaagtaggaagcagaagaaaaaagacaagctaagaattaaaaagctaaggacaaatgtacaaaccttagaagcaaaataggcagatagaaacaagatagaaaaagaacaacattgtcaagaagtttaaaattaaaacattgccaatcacaggctaagaccatagtatatcgaacagtattaga

SEQ ID NO: 44959 - DNA, 371 bp, Homo sapiens
agataaagacaaagaaagaagtagggatgaaagagaacgatcaacaagcaagaagaagaagagtaaagataaggaaaaggacctggaaagaaaatcagagagtgataaagatgtaaaagttacacgggattatgatgaagaggaacaggggtatgacagtgagaaagagaaaaaagaagagaagaaaccaatagaaacaggttcccctaaaacaaaggaatgttctgtgggaaagggaactggtgattcactaagagaatccaaagtgaatggggatgatcatcatgaagagacatggatatgagtggctaattattgcctctgcgggagtccaactgttacctgcatcagtagtcattcctatagatgtg

SEQ ID NO: 44960 - DNA, 183 bp, Homo sapiens
ggtgtgccactcgcagaccagacttgctgactgatcgcctgctcgcttttctcgcaaccattttacaaacccgaagggctagacgagaaactcgaatagtgaaacgtaagaagacagagacgcaagagaaaaatcaccttccgtccaaagaaacgatttaacaggagaagcaagcaggcgaac

SEQ ID NO: 44961 - DNA, 226 bp, Homo sapiens
attgatattctgagattgttaaagaaagtgtatcaagaattaagaatattttaagcacaatatttatattggatatcaactgctgtaaggtgctctctttttctggtcattgctggtaagatagtaatatttgggaggtttaaagacgcatgtatggtgctaatgtactgtcactttgaacctctggataggacttgtggacttgcatccagacataattcacaaa

SEQ ID NO: 44962 - DNA, 208 bp, Homo sapiens
gattgtattctatgagtcccagaagatgaaaaaaattttatacgttgataaaactgataaatttcattgattaatctcctggaagattggtttaaaaggaaaggtttactgcaggactttaaggacaatatttttaaggccacatttattttattattggtgatcacctgctgttaaaggtggtccactttttgcctggtcattgctg

SEQ ID NO: 44963 - DNA, 292 bp, Homo sapiens
aatctggattcactccctctggttgatacccactcaaaaaggacacttctgattaagacggttgaaactagagatggccaggttattcatcgaaccttctcagcatcaagatgtccttaattaaaacttgtacacacttcagtccagcattatattaccagcaggacttaaaaaggaaatccatatctcaaaggaaccagctttcaggtctctttgctgcagtttttcaggtgcgcaacgatagatttcgagtaggattatgctctagttcttaccatccgccactcctcca

SEQ ID NO: 44964 - DNA, 208 bp, Homo sapiens
tgagcggacaaacggaagtgtaggttacggtctgagacatcaccgccaagctgggcatcggggagatggccgagactgaccccaagaccgtgcaggacctcacctcggtggtgctagacactcatgcagcagatgcaagataaatttcagaccatgtgtgaccagatcattggggagaattgatgatgatgagtagtcgcattgatgt

SEQ ID NO: 44965 - DNA, 218 bp, Homo sapiens
  misc_feature 204: n = A,T,C or G
agaagaggatctggttgatactctaaaggatgttgccagctgcattgacagatgctgtaaggcactgaaaagcggatgtctggactctcagaggccctgctgcctgttgtacatgaatacgtgctttatagtgaaatgttaatgggcgttatgaaacgaggagaccaaatgcaagccgactggattccaacgttgaggttttancctataaaaggcag

SEQ ID NO: 44966 - DNA, 200 bp, Homo sapiens
  misc_feature 37, 156: n = A,T,C or G
aaatatgctgaagaagaccggcgaaagaaggaacganttgaagcagttaatatggctgaaggaatcattcacgacacatataccaagatggaagaattcaaggaccaattacctcatgatgagtacaacaagctgacagagacgatttccaaaatnatgggagactccttgcatagaaaagacagccgataggaaggaga

SEQ ID NO: 44967 - DNA, 218 bp, Homo sapiens
tgatgacttctagcaagcctcgctaacctcgccttgccccccactattaacctactgggagactctctgtgctagtaaccacgttctcctgatccaaatatgactctcccacttacaggactgcaagcatactagtcaccaggccctcttactccctctacatattttaccacaacacagttgggggctcagtcacccaccacagttagccaacatct

SEQ ID NO: 44968 - DNA, 206 bp, Homo sapiens
gaagatgagagatggtcagatggaagagaggaatacatgaactgctctggcctctctggttctgttcttggcccagagtttttgaaaagcagcggacatgactgacttcacatgctcagctttctcagccttttgtttattttgttgtccttagatttccctgttgtaaaaggggcaagaaaagtaactcatcatctctaacacac

SEQ ID NO: 44969 - DNA, 208 bp, Homo sapiens
ttcagacctcatcaatcagcaaatccatctgaactgtacgaggagaagctctctttactgagggtgctttagctttgtaggatgaaaacctcaaactaacagggtctaccttgtcgagaatcgtgtcagtctcatgggtaaagcagagtccatactataggagagatttgaattcctcggtgacagcgtttcgtgcccctcgatccca

SEQ ID NO: 44970 - DNA, 200 bp, Homo sapiens
attttcagtgtcaaatatatttaactatttagagaatgatttccaccttttatgttttaatatcctaggcatctgctgtaataatattttaagaaaaatgtttggaatttaagaaaataactcgtgttactaatttgtataacccatatctgtgcaatggaatatagatatcacagagttgtttaactataagaaagcat

SEQ ID NO: 44971 - DNA, 225 bp, Homo sapiens
ctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtgaaaaaaaattttcgtaaactttgttttatattaaaagaaaaatccat

SEQ ID NO: 44972 - DNA, 218 bp, Homo sapiens
acgttaactttgaaggtgcttgtttgtattagctctgctaggtttacctctacaacgtagatttcagcagctatgctgactgacactacattctagttcttaagattttatttccagatccccccttccccagctagacatacgtagcatactttcatcttattcagtctttctgtaacctgctgctgcttttagtcctcctcacctcagatcggatt

SEQ ID NO: 44973 - DNA, 229 bp, Homo sapiens
cgagctgagccctggccgccgccacaatgggccgcgagtttgggaatctgacgcggatgcggcaatgtcatcagctacagcttgtcaccgttcgagcagcgcgcctatccgcacgtctttactaaaggaattccccaatgtcctgcgccgcattcgggagtctatctatcgcgtggtgccgcagtttgtagtgttaatcttatctacacatggggggacttaagagttc

SEQ ID NO: 44974 - DNA, 200 bp, Homo sapiens
attggaacaataagttatgttacatgcacactcaaattctttattttctccactttaagcaggaaagggtaaaaactgtcttggtactcaagcccagccttacatactgtgtttctctctctgtctgcatgcatattaaagtggaaaacttgtatttatatctgagttatttaccatagtacctatgaacctttatcagg

SEQ ID NO: 44975 - DNA, 230 bp, Homo sapiens
ttcttaaatttttgtaaaagactataagtctagacatctttctcattcaaatttaaagatatctttctcctcttgatcaatctatcaatattgatagaagtcacactagtatataccatttaatacatttacactttcttatttaagaagatattgactgcaaaataattgacatatagaactctacaaacatatgtccaaggactctaaattgagactctccacatgta

SEQ ID NO: 44976 - DNA, 225 bp, Homo sapiens
aacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttaca

SEQ ID NO: 44977 - DNA, 160 bp, Homo sapiens
tgtggacatttaggcctaggtgatgcatttgctcttcctgtttgtgccaatgtatcaatgtagagttgctctgttttcttcaactgtatttattgctgcatttctcagcataaacttatcccattgtatttttataaataaatatttaattggaacttac

SEQ ID NO: 44978 - DNA, 170 bp, Homo sapiens
aattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttcttcattttgcatttgggc

SEQ ID NO: 44979 - DNA, 130 bp, Homo sapiens
gaaaaaaacttaaaaaaacaatgaattttgaatcgctttagaggatcacctattatcgaccccaccaatatggccccaccaccctaatcatcattaaaaaaaaagcaatagtccccaaccaaaataaggc

SEQ ID NO: 44980 - DNA, 287 bp, Homo sapiens
agagagagaaatgctaaccttgtagcatgtgaagaatgtctgtaccttgatacgatagttacataatcagtatatttggtttctagatcactgtgcttattttgtttcaatctctgactaaaaatacttaaatttgggttgttaattcttattttagacaattataatttcagtttatattaatcggctatagcttactggaggaatctttccagttggagggaggtctaatattcacatggtctaatactgtggctattgtaaacagctaaatttggggttacgta

SEQ ID NO: 44981 - DNA, 230 bp, Homo sapiens
tgtatgctttgaagcaccttccctgagaagggaagaggggatctttggactaggttcttggctccagacctggaatccacaaaagccaaaccagctcatttcaacaaaggagctccgatgtgaggggcaaggctagccccctgtccccagggctctttagaaaggcatcttcattttgaacaccatcatgacctttataaagggttccgtatttcagggaaaggcattar

SEQ ID NO: 44982 - DNA, 203 bp, Homo sapiens
tcttttggttgtatttattatgtaggttgaattactctacatttacagagcttttgggaatcaggagatgagaaaacacaataattaagcaaaagggcagttagtactatcctaaaactaaacattggcccatgtaatcacatgctgagtaaaataaactgacagtaggttaagacaattatagcagtttagacgaatttagt

SEQ ID NO: 44983 - DNA, 259 bp, Homo sapiens
tgggaagttgatttaaatgactgataatgtgtatgaaagcactgtaaaacataagagaaaaaccaattagtgtattggcaatcatgcagttaacatttgaaagtgcagtgtaattgtgaagcattatgtaaatcaggggtccacagtttttctgtaaggggtcaaatcataaatactttaggctttatggccatattggattctgtttacatattttgtttttttgaacacacgcgttttatataggggcacaaatchw

SEQ ID NO: 44984 - DNA, 203 bp, Homo sapiens
actgttggaaatgtaacttgaagcagctgctttaagaagaaatacccactaacaaagaacaagcattagttttaggctgtcatcaacttattatatgactaggtgcttgcttttaatgtcagtaaattgtttttactgatgatgtagatacttttgtaaataaatgtaaatatgtacacaagttaaaaaaaaaaaaaaaaaaa

SEQ ID NO: 44985 - DNA, 207 bp, Homo sapiens
aaattaattagaaaaaggcaaattactcaatatataaaatgtattgcatttgtaataggtaggtatttcattttctagttatggtgggatattattcagactataattcccaatgaaaaaactttaaaaaatgctagkgattgcacatttaaaacatcgtttaaaaagcattgagagcttataaaattttaataagggatcaaaccm

SEQ ID NO: 44986 - DNA, 251 bp, Homo sapiens
tgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccatttctgagctagtttttttgtactattatactaaaagctaccacgtgtatg

SEQ ID NO: 44987 - DNA, 177 bp, Homo sapiens
ctgacggtaacggggcagagaggctgttcgcagagctgcggaagatgaatgccagaggacttggatctgagctaaaggacagtattccagttactgaactttcagcaaggtgaccgtttgaaagtcatgatcttcttcggaaaggtttttcttgtgtgaaaaatgaacgtttgctag

SEQ ID NO: 44988 - DNA, 240 bp, Homo sapiens
tgtagaatttatttcacagtgaggttccttgtttgaatttgcacttggaataaaggagtcatattctgaagagagactgaaagagcagtttgagaaaagaaagctaacaatcagctttatttttttcggaaatgtggggacacaaacctacttctatggcaaaaaactgaggattgaatttcctgccgtggtctacttttccacagggctggttcgaaaccatatataggtcgaaaaaar

SEQ ID NO: 44989 - DNA, 196 bp, Homo sapiens
taagatgcggcctagcagcgcgaggttctttgcgcctcgaagaagaataatcagccgggtgcctttgtgagaagaattccttgacctcggcgatgaggcagcctaaagaacacatttcacaggttggccaatttcagaagggtcaatttagccttttgacaaggaggacctgcctttaaaaaagggtttggggtgg

SEQ ID NO: 44990 - DNA, 160 bp, Homo sapiens
cgagctcagtccagttataagcgtvgcttatactaccttgtactcggtgaagttggcgtggggtcggtgtttaaccccctgatacttgttgtgggcagcgtgcctgtcaacggtgcgattccggctgtccgtggtgtggttttggctttggggggtgcgt

SEQ ID NO: 44991 - DNA, 114 bp, Homo sapiens
cacaggcaaagtcatggataccttagaacaagatgcaaaggaaagagaaaagcaggcaaacaacctaacacgagcagaaacagactgaaagagccgcccccgatcagccgaccc

SEQ ID NO: 44992 - DNA, 269 bp, Homo sapiens
aaatctgaccaagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggcatttctgattcatttaaaggatttacaaattcatcaacccctgaaaactgaagcaaattgaacaggga

SEQ ID NO: 44993 - DNA, 306 bp, Homo sapiens
accctgagactgacccgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatcccagaacgctctaagactgtacaggagactcaataggggagactgttatgactacagagctttgcgcgacgctacgccataggtttataggatacacagctgt

SEQ ID NO: 44994 - DNA, 228 bp, Homo sapiens
  misc_feature 213: n = A,T,C or G
aggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttngtgtcaaaaaaaaaa

SEQ ID NO: 44995 - DNA, 310 bp, Homo sapiens
gcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggcttaaatacatatggatcttactctcttgcaccaaattatcttgatacagtcaaatttgtctgtggtaaaaaataggtgtgtagatattgagggcccagagatatatgcacagatacatatagagcgctca

SEQ ID NO: 44996 - DNA, 279 bp, Homo sapiens
ccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgatatgctctggtggtggtgtcttacttcctcatcaccggaggaataatttatgatgttattgttgaacctccaagtgtcgggtctatgactgcatggacattggcatcagaggccagataggtgtcttk

SEQ ID NO: 44997 - DNA, 257 bp, Homo sapiens
aagcagttccccacttcaagttttccttgagtttagtgattggaggggtccaaaattacttttcacatttgccccttttttgtttttaaatagtcttttggctgaaccgcttttttgataaggatatggatgttctctgtgtcctgcagtgtatgccgtctggatcctgctcccccacccccccccccccccccccccctgggtctgaggtatgcggtttatgccctgaggatgaggatgaggtgcctgtatggtta

SEQ ID NO: 44998 - DNA, 308 bp, Homo sapiens
ttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggacaaatacacaaggaagcatggttgtcttggccacatgaacactcgcactctttgtcaacacgtgactatagcagactttcccgagagccatcggagtatctttaggc

SEQ ID NO: 44999 - DNA, 194 bp, Homo sapiens
gcataggaaggaaaagaaaaagggttctaaacattacggaggcttagatttaagctttttacgtgaggataaaatgtattttcgcagaaaatttttgagaaaggaccatagagccccgaatttttatcaaaagtaagggcaaagctattagcaagacgatcataggacacctatacaagcaagtaggtaatgtc

SEQ ID NO: 45000 - DNA, 143 bp, Homo sapiens
agaatataataactctccagttatagtcaattactacccatgttgtacaacagatacgttctgtcttagttgctaataaagggctacacaactcaaaatagtctggcttaaacttattgctctgtggtatatatgacatatgg

SEQ ID NO: 45001 - DNA, 233 bp, Homo sapiens
aaacaatatacaacagagaattagagaagctgaggaattaagtgagagaacctcaggacagaatgagaaaaaccatcaattgatataatgatgactaaagtaggaggactcacaggaatgaataaacaccacagataatgtcttaagataaacaggagatgactaaaaggagaattgaagccaaaatgaataaaaattaattatgggagagactcaggagagaatgagataga

SEQ ID NO: 45002 - DNA, 301 bp, Homo sapiens
gaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaccacactatatctgagatcccaacacaaaaagtttcactccatagtgtgtccctctcgttctatcttgtcagccagtgcgtgtgaccgaccaaa

SEQ ID NO: 45003 - DNA, 310 bp, Homo sapiens
ccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgtaaagctaagcctcgggctaatttccccatagccgtggggtgacttccctagtcaccaaggcagttaatgcatgtttggggtttccataccgctccaataaggatgtaccaaaacatccccctaaggtgcttggatttgacaccttccc

SEQ ID NO: 45004 - DNA, 230 bp, Homo sapiens
tcatttacataaatattatactagcatttaccatctcacttctaggaatactagtatatcgctcacacctcatatcctcctactatgcctagaaggaataaataactaatacgctattcaattaataagctactccttataaacccttaagaccccaattccgtggttaaggccaatacttgtgccctcattcgcgcataactcagtgctcttgcgcgcctcgcgcaaga

SEQ ID NO: 45005 - DNA, 270 bp, Homo sapiens
tggggaaagacaatcattgaatacaaaacaaataagccatcacggctgcccttccttgatattgcacctttggacatcggtggtgctgaccaggaattctttgtggacattggcccagtctgtttcaaataaatgaactcaatctaaattaaaaaagaagaaatttgaaaaaactttctctttgccatttcttcctcttcttttttaactgaaagctggatccttcccatttcttcgcacaactctcttgctctaaaatgtgtgggcaaa

SEQ ID NO: 45006 - DNA, 226 bp, Homo sapiens
ttttcaggagcgcaagatagatttggaataggaataagctctagttcttaacaaccgacactcctacaagatttagaaaaaagtttacaacataatctagtttacagaaaaatcttgtactagaatactttttaaaaggtattttgaatactattaaaactgcttttcttttccaccagtatccacccatcttgggtctgcttcaataaatctttgggagacctta

SEQ ID NO: 45007 - DNA, 245 bp, Homo sapiens
tcaaagacatcccgtgactgtctataagccaattattaaagcatacaccagattcattgatggagtgcctgtggaaataactgacgaaggagacaaggggaggccggtatcaattacaggggcctgagcataaataatacactagggattttctactggagggtgggagagacaagaggatcctcgaggagcttgttaacaggagggggtccaccaggctccaccactttcatttgagggggggg

SEQ ID NO: 45008 - DNA, 326 bp, Homo sapiens
aaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaaggaatatgggttttcacttccagggtatggtgttcattttatgatattacgcaggatgatgtattgaggaaaagcagagtttgtaaatatgtaaatatgtcacacacaaacactgctttgactctatttcaca

SEQ ID NO: 45009 - DNA, 430 bp, Homo sapiens
gaaatactgggaaatgcaacctgcaacatttcgttgtgttttgagcagaatgagtgttcagcttgggaacttgtggaatgtaataattagtaattggtaatgtccatttaatataagattcaaaaatccctacatttggaatacttgaactctattaataatggaagtattatatatacaagcaaatatctattctcaaggggtaagccactgacttattttatgacaagaaatttcaacggaattttgccaaactattgatacataagggttgagagaaacaagctctattgcggttcttttgcggacaaatgacttacataaatctatgctgaccattccttttttatacaaaaaagaagaattcgggattaacacttggtatcaagcacatttaaaagaccggactggaaatggaatggctggctta

SEQ ID NO: 45010 - DNA, 435 bp, Homo sapiens
gctccccaaatcccatgatcgtaatactgttgaaggctgtttccatcaataactttacaaacaaacaagctagtggtcagcttgaagaaataactacttgattagctgaccttactattagaacctttactactgttactactaggaaaaaaatgcaattgtgccttaaatgaaatgaagcacatatttacaagctaattatatggaagacttgtatatacctatatactattttaaaaagaggaaattgagaccaaatatattaatactaatcacatttaatttttcttaatatattaatatatgttcttaatatatcagtaaatgtgaatgagcataacacacctactaaaataaaaaagaatattggctaacaatacaaaattcaactctatctatattgaaaggcacaattaaaaagagattcacaagggt

SEQ ID NO: 45011 - DNA, 300 bp, Homo sapiens
  misc_feature 292: n = A,T,C or G
acagagcttttgggaatcaggagatgagaaaacacaaataataagcaaaagggcagttagtactatcctaaaaataaacattggcccatgtaatcacatcctaaataaaataaactgaagtgggttaagaaaattatagcggtttagaagaatttagtgtgttttctagccccattttcatttgattttgatagtaatgattattaaaggaagacagagtactttgtacttttaacatttagccggcagcagcaattgcagcaatatccaaagtgtattgaatgtctttggngtagaaaa

SEQ ID NO: 45012 - DNA, 526 bp, Homo sapiens
aactgtgtagaatttatttcacagtgaggttccttgtttgaatttgcacttggaataaaggagtcatattctgaagagagactgaaagagcagtttgagaaaagaaagctaacaatcagctttatttttttggaaatgtgggaacacaaactactgctagggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatgggagagaaaaacaatgcattcattgttgccagctttgaaaat

SEQ ID NO: 45013 - DNA, 602 bp, Homo sapiens
gcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagagggatttgttgggaagaaatagaatctgagctcttatctacggagtt

SEQ ID NO: 45014 - DNA, 486 bp, Homo sapiens
tctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccaca

SEQ ID NO: 45015 - DNA, 417 bp, Homo sapiens
gagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaagacattctagggcagagaacccaggatgggacactaaaaaaatgtgtttatttcattatctgcttggatttatttgtgtttttgtaacacaaaaaataaatgttttg

SEQ ID NO: 45016 - DNA, 552 bp, Homo sapiens
gggaaagatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttaggtataagtaacatgaaaacattctcctccgcataagcc

SEQ ID NO: 45017 - DNA, 142 bp, Homo sapiens
  misc_feature 142: n = A,T,C or G
tacaatagcattgattcaccttgtttttttaacctggttgttgttgatagagcttgtttccacaatcaccttgggttaaggtttaaattcaaggttaccatttacatttctattcgacagggaaaaattagtgcatactttn

SEQ ID NO: 45018 - DNA, 192 bp, Homo sapiens
ttgggggttgcagtgagctgggattgcaccactgcactccaacctggacaacagagcaagaccctgtctctaggccaggtgcagtggctcacacctgtaatcccagcactttgggaggctaaggcagacagatcacctgaggtcaggagttcgagacctgcctgagcattatagcgagaccccgttctccag

SEQ ID NO: 45019 - DNA, 189 bp, Homo sapiens
tatgtatctttataatcagactggaaacgggactttctattaatatcattttcagaataaaaaataggataatttaacctaccagcccttctcccccaataactgtggtctatacagagtcaatatatttcagcagagaaagttattcgctcgattttttctgaatcataattaaactttataaaacgt

SEQ ID NO: 45020 - DNA, 328 bp, Homo sapiens
gaggaaacatgacgcaaccaaaaatgatttggctcatttaaaccacttgtagaatttttcctccgaatttaaccttctgagcaacttaactacatatgagttatgtctgacagttaagaaaataataaaaatatgagacggcacacttatcttctttgtcagagagaccatatctgttttgggagacgggctgtcttagggcagtaactcagatgactgataatatatcctgacttctttcacactcactttatttagacaacataacttttgtatatgatatgtgttctgacatacgattatatcactcactgacttccttccacca

SEQ ID NO: 45021 - DNA, 266 bp, Homo sapiens
tgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggcggatctgcagcttactcataacatgatcacaaagctgggctcttttgaagggattggtaaacctgatcttcatccagtctctcagcacaagtcagtctgcttgaggatgd

SEQ ID NO: 45022 - DNA, 262 bp, Homo sapiens
gccctgggcagcagcattcattgtaagttccctctttgaaaactggtgtgtgggtgttcagttctgtgtctggtggggtatggacagacagtaatctcctgtgatctgtgctagctgtgaggcagctctggaacgtgaggagctgtttggtttgaaccgtgaacaaaactgtgttttgagtttagctgacattaaagaaaaagttcatcacgtgactctttaatgtaaacctcggttattaaagtacactatgaaattacct

SEQ ID NO: 45023 - DNA, 334 bp, Homo sapiens
gacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctcgctaggagaaactatcaatgctggcagccagatttgaatatacgtagaaggagttgactagccaagaaacgtggctacccaactgtgcacttatgctgctgctggccaactattgcctcttcagttacatcatctacatctgcaag

SEQ ID NO: 45024 - DNA, 168 bp, Homo sapiens
aaaaatggtaaattattaactctaagaataatttatttvattttaaataatattcaactgttttcctttaaagaaaatgatgctattttttgcttattatgaatactgacctctgtttctgcccctaaatgctgacacatggcttcggtgacaggtaatataaagtta

SEQ ID NO: 45025 - DNA, 172 bp, Homo sapiens
acacgatggaagaccatgctgctgaggcatccgggaagcctctaggtgaaattagtgttccactggacagctctttactttgtactttgtccctcagaatctcaccagggaagcagctagtaatgaagaatgattaacacacctggctagcgacatagtatgttgcttctac

SEQ ID NO: 45026 - DNA, 224 bp, Homo sapiens
acgacctgaaggtggagctgtcccagctgcgcgtcgccaaagttgacaggcggtgcggcctccaagcttctcttaagatccgagttcggtccggaaatccatttgcccgttgtttcttcacagttatttaaccaggacttcaagaaagaaaaccttcaggaaatttctaacaacgggcaaagaagtacaggccccttggaccttgcggccttaagaagacacag

SEQ ID NO: 45027 - DNA, 219 bp, Homo sapiens
ctccatgttggtcaggctggtcttgaactcctgacctcaggcgatccgcctgcctcggcctcccaaagtgctgggattacaggcataagccactgcgcccagccagaagatgcatgatttcttaggatcatatcctggtttttagccataaggtaatcatgtctcttccaatcatgaacttggaaaactccctaagttaataaaaaacggagggtggga

SEQ ID NO: 45028 - DNA, 213 bp, Homo sapiens
aattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattggtgctgtacaagg

SEQ ID NO: 45029 - DNA, 191 bp, Homo sapiens
aaatggaagagaaatgtagggaatcaaaacaactagttttttcctttataacggaagttttataattcatcttttatgtaagtgtaattctcattaaaaataccctaaagcttaaagtttgaaggctgcccagcctaacccacaacagtttgatgctgccccctagcgtttgattcccttaaccttttgct

SEQ ID NO: 45030 - DNA, 200 bp, Homo sapiens
tcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttacactcctggactgtgactttaaa

SEQ ID NO: 45031 - DNA, 208 bp, Homo sapiens
ccgagtgacaccattgagaatgtcaaggcaaagatccaagacaaggaaggcatccctcctgaccagcagaggttgatctttgctgggaaacagctggaagatggacgcaccctgtctgactacaacatccagaaaagagtccaccctgcacctgggtgctccgttctcagaggtgggaatgcagatctttcgtgaagaccctaactgg

SEQ ID NO: 45032 - DNA, 205 bp, Homo sapiens
aaacaaatgttaccaggaagtagccaaactccttagggaaaacagaaggaaagacatagagataataaatgcaatggtggaggaggaagccaagaagtggaaggcagctgaaggaaaagagttccgtttgagatcagcaaagaaagcttctgctctttcagatgcgtctagaaagtggttttaaaagcaagagataaatgcggct

SEQ ID NO: 45033 - DNA, 153 bp, Homo sapiens
ctgcctaagccaactcgaaaaagccgtgcaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaattaaaaaaaaaaaaaataaaaaacaacccca

SEQ ID NO: 45034 - DNA, 194 bp, Homo sapiens
cgttggtgttgcggttgcatcgttcgggccgtcctccctggcttccgggttttgccgggcctcggttgcgtggccttctggccgggcgtctgcgaattcctttggctgtggccttcgtgctttcccgggggaggcagcttggtacaattttcgagaaggcggatcatagacagggagccatacgccgttattaa

SEQ ID NO: 45035 - DNA, 200 bp, Homo sapiens
aaaggtaattatctggcgaagtgaaattttattgtgataaatattattagtcattgtatatttatgctaagatggactattcatatgtaaattagtcaaaagctgaagaaaatgaggagttaaatcaatgaaagcatttcagagttgatttatatgatattcaaaagtagtaacttatttatcaaagcctatgagtctaa

SEQ ID NO: 45036 - DNA, 207 bp, Homo sapiens
ccgagatgtctcgctccgtggccttagctgtgctcgcgctactctctctttctggcctggaggctattccagcgtacctccaaagattcaggtttactcacgtcattccagcagagaattggaaagtcaaattttccggaatttgcttttgggtctggggttcatccatccgacattgaggtttgcttcctgggggttggggggggg

SEQ ID NO: 45037 - DNA, 212 bp, Homo sapiens
aaaaataattatgttgcttgcttaatgattcccaggaaacttcgttgtaggcatatattttataagagtattatacagtgttaactatgcaagtaaggttctaaaattacaaaaattatcttggggaatttttttgggcccaataccccgtgattttttcaacccctgttctagagatatccgggaatgtcaaatttccccaaattggagag

SEQ ID NO: 45038 - DNA, 182 bp, Homo sapiens
taaagtatcatttaaggtttatctgagggaccacagacacttaacacaatcaatttcaggaaaagatcagttatttcattgtgatttgggggctggatcttttatggtcttttgggtttacaaactgtttaaacccatattggactttcacattttgttggttgaggggggtggctccctta

SEQ ID NO: 45039 - DNA, 203 bp, Homo sapiens
caattttctaaactgcttctgcttagtaagcaaaagtttgctactttttctttaaggaaaacttttctttaagaattttctttttcatagcagtcaaaccattgtttaaaaacagaataatttggtttttcatattcaattgtaggcacattgaaagggccatggacaattgcagaggcctctagtgtatcaggaacatagtt

SEQ ID NO: 45040 - DNA, 200 bp, Homo sapiens
ctgaggatttttggtccgcacgctcctgctcctgactcaccgctgttcgctctcgccgaggaacaagtcggtcaggaagcccgcgcgcagagccatggcttttaaggataccggaaaaacacccgtggaggccggaggtgggcattaaccgaatttcgaatcaccctaacatgccgcaaggtaaattccttggaaagggg

SEQ ID NO: 45041 - DNA, 114 bp, Homo sapiens
aacttctaaagtttcgtaagttgcgtcgtcgtcgtcgtcttcgtcgccgcgcgcgcgcgcgcgcggcgcgcgggtggtttaaaaaaaaagggggggctaaatatataaaaatgg

SEQ ID NO: 45042 - DNA, 225 bp, Homo sapiens
aagaaggtagagataaagacactttttcaaaaatggcaatggtatcagacttcctcaagcaggcctggtttattgaaaatgaagagcaggaacatgttcaaactgtgaagtcatccaaaggtggtcccggatcagcggtgagcccctatcctaccttcaatccatcctcggatgtcgctgccttgcataaggccataatggttaaaggtgtggatgagcaaccat

SEQ ID NO: 45043 - DNA, 251 bp, Homo sapiens
  misc_feature 221: n = A,T,C or G
acatttcatccttcaattcctcggtattgattttatgttgattgattttcagaatttctctacagaaacgaaagggaaattgtctaatctgctttatccatgtacttgcatttcagacatggacatgctattgttatttggctcataactgtttccaaatgttagttattatggacccaatttattaaccaacattagctgatttttacctatcaggattnattttcaatccccccagggtatagggccgt

SEQ ID NO: 45044 - DNA, 181 bp, Homo sapiens
ttacttaaatatatagagaccagttttctctggaagtttgtttaaatgacagaagggtatatgacttcaagaaaatttaaggtgaaaaaatgtatttgctataacatgagaagtctcactgatagaggttctttattgctaatttttaaaaacatggacttttgaaatctgttaaaataaa

SEQ ID NO: 45045 - DNA, 242 bp, Homo sapiens
accaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacaggttgatgtcaatgttcaggatcatttctgggatgggaaagggatgtgagatgatct

SEQ ID NO: 45046 - DNA, 244 bp, Homo sapiens
  misc_feature 214: n = A,T,C or G
ttgaagatgccgcatttggattggatgaattccaaattctgcttgcttgcttttaaatattgatatgcttatacacttacactttatgcacaaaatgtggggttataataatgttacatggacatgatctctttataattctactttgagtggctgtctccatgtttgatgtatctgagcaggttgctccacaggtagctctaggagggctggncaacttagaggtggggagcagagaaattct

SEQ ID NO: 45047 - DNA, 192 bp, Homo sapiens
ttaaattaattgataccagatttcactggaccagtttcaactgataatttatgacaaagaaacatacctgtaatattgaaattaaaaggtgaaatttgtcataagggatttcttttattttggaaatcgagtttgtaaatgtccttttaagaagggagatatgaatccaataaataacctcaagtcttggct

SEQ ID NO: 45048 - DNA, 240 bp, Homo sapiens
taagttaacttccaatttacatactctgcttagaattccggggccaatttagaaatataattgcacaggacttattggcaatttcctataactggatgccaacattttgtcacatcagaattcatcattctacttcttatacatttgatacaggtcaaggccatggctctgtggtttaactctggctctcattttttgcttcccaccaggttcacataaactccatacacacttgacaca

SEQ ID NO: 45049 - DNA, 228 bp, Homo sapiens
ttctgacctgaaggctctgcgcggacttgtggagacagccgctcaccttggctattcagttgttgctatcaatcatatcgttgactttaaggaaaagaacaggaaattgaaaacccagtagctgtttctgaactcttcacaactttgccaattgtacagggaaattcaagaccaattaaaattttaactagattaacaattattgtctcggatccatctcactgcaat

SEQ ID NO: 45050 - DNA, 245 bp, Homo sapiens
taattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgcc

SEQ ID NO: 45051 - DNA, 240 bp, Homo sapiens
attcgtttttaatcctcccacagggccctggccaaggcaaaccagaactcttatgtagaccaggatttttctgtgtgtttctcttttaacttacagccttttctgaaactggtacatgttttttaaagtttgtgggaggaaagccagcgcgtcagacagagcccccccagcccgttccacacggaacccaatgccaagcctccatagcttctccccagagatattttgggtgggacaaac

SEQ ID NO: 45052 - DNA, 188 bp, Homo sapiens
atagtttaaaatatgtagccacggggaaggggaggcatgtaaatgtcttgatgaggagaaaaagtatgatagaggatacgatagttacgactactgtgtctgatgaggcgaaatctttaaacgatttaattcctctttaccagtaaattccaattctttagggatttttcttttattaggaggaattt

SEQ ID NO: 45053 - DNA, 300 bp, Homo sapiens
aaaactcaatattagtggcaaatattaatactattaacatggattttggtgctatattcttgtagctaaagcctagtagacttcttaagaataggtaaaataaattttcaaagttgcccttcatttaaaagaccaattaagaattttgaattaattaaattagaagatggttagagacttaagggagagttagcttggtgatttaattccgacttcatgtgatttgattgaaataacccacatcctcgctgtgtatatgagatacgctctcggagaggtacatgtaaatagagttctata

SEQ ID NO: 45054 - DNA, 305 bp, Homo sapiens
gagatgtccaatggagctttctgcaatgataggaatggttctgtatctgcacagtctaacgtagtagccagtagtcacatgcatgtgttgagcacttgaaataaggaatagtgtgcccgaggacctaggttttaaattttgttgatttgtaactaatttaaatttaagtggccacatgtggctctgggttactgtattggacagcacagattcttgactgacctatcaattatgggagacacagggaacagagtaacatgttgagtgacaccataggtagtgcaaacagtcaaacacactctatg

SEQ ID NO: 45055 - DNA, 272 bp, Homo sapiens
ttctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaccttcctgaagatgtccttgatgtgcagctggcatatccttcgcacttctctccagccgaagcttcccagaacatcacatatcactgcaaaagtagcattgcatacactgcgttcag

SEQ ID NO: 45056 - DNA, 267 bp, Homo sapiens
  misc_feature 262: n = A,T,C or G
ggtgtgattccgtcctgcgcggttattctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactctaaggtggataatgctgaaaatgagcaccagttatctataagacggtcaggttaggggataggcgcaaacgttgacgngcaca

SEQ ID NO: 45057 - DNA, 329 bp, Homo sapiens
  misc_feature 37: n = A,T,C or G
acagatgtttgaaggataataagtgaatattataatnaactttttgccaataatattcaacttttgaagaaatgcacacaatttcttgaaactagcaaactaccaaagcttactcaggaggagacaggtaacttgagatagtcctatatttaaggcaattgaacttgtaaaccttcttacaaaactgcaggaccagaatggcgttcagctgtttgagattctactgtatatgtaagcgaaaacagtatctcaaattaccatacatactctgttcagagagagtggggagcmgggcatayctctchgdgyahwctctgcwgcgcagcagc

SEQ ID NO: 45058 - DNA, 187 bp, Homo sapiens
aaatgcaaaaattagccgggcgtggcggcacatgtctgtaatcccagctacatgggaggctgaggtgggagaattgcttgaacccaggaggcggaggcagaggctgcagtgacccaagattgtgccactgcactccaccctggggcaacagagcaagaccccatctcaaaaataaataaatatataa

SEQ ID NO: 45059 - DNA, 334 bp, Homo sapiens
aaaaataaagatgttctttgaaaccaaccagaacaaagacacaacataccagaatctctgggacacattcaaagcagtgtttagagggaaatttatagcactaaatgtccgcaggaggaaagcaggaaagatccaaaattgacaccctaacatcacaattaaacgaactagaaaagcaagagcaaacacattcaaaagctagcagaaggcaagatataactctaattcagagcagaactgagggatatagagacacaaaatacgctttcataaattaatgaatccaggagctgctttttttgaaagggatcaacacagttgattgaccgctagc

SEQ ID NO: 45060 - DNA, 340 bp, Homo sapiens
aaagagacaaaagcagccgatccaccagctgagaattcgtccgctcccgaggctgagcagggcggggctgagtaaatgccggcttaccatctctaccatcatccggtttagtcatccaacaagaagaaatgtgaaattccagcaataagaaatgaacaaaagattggagctggagacctaaagtgcttattttttgcccgttgaccagataactagaactcttctgcattatctatgcagcatggggtttttattatttttacctaaagacgtctgtttttggtaataacaaacgtgttttttaaaaaagcctggtttttctcatacgcctttaaaggag

SEQ ID NO: 45061 - DNA, 289 bp, Homo sapiens
aggagactggcaacctgaaaaaggctgtcattctacagggctctaatgatgttgaacttgttgctgagggcaacagcaggttcacttacactgttcttgtagatggctgctctaaaaagacaaatgagtggggaaagacaatcattgaatacaaaataaataagccatcacgcctgccttccttgatattcgcacctcgcggacatcggtggtcgctgaccatggaattctctcgtggacacacggccccgctactgttttcatataaaatggaactcactctaaaatt

SEQ ID NO: 45062 - DNA, 403 bp, Homo sapiens
cgacggtggtggtgactgagcggagccggtgacaggatggctgggcacagagtaagtttcttcacttagctcctactaacagtggtggttgggtggctgtttactgactcgatttcttacccttttaagttggtgttagtattaggagatctgcacatcccacaccggtgcaacagctttgccagctaaattcaaaaaactccttgtgccaggaaaaattcagcacattctctgcacaggaaacctttgcaccacagagagttatgactatctcaagactctagctagtgatgttcatattgtgagaggagacttcgatgagaatctgaattatccagaacagaaagctgtgactgtttgtcagttcaaaatttggctgatcatggtcatcaaggtattcatk

SEQ ID NO: 45063 - DNA, 473 bp, Homo sapiens
catcttccaccaagaacaattggactatccatggactcttgtttatgcgtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtgtacaggagataatatgttttttatcaaaggagacatggattcactagctttcggtggtggaggaggagaatttgcgctttggcttgatggagatctctaccaagggaagaagccattcctgtaaaacgtttggggaatccgtacacctttctaaagaagggaagatttccttaaccaaagataattggaaatccgggggcttttggaataaaataaaaat

SEQ ID NO: 45064 - DNA, 603 bp, Homo sapiens
  misc_feature 482: n = A,T,C or G
gaacttcctgagagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcctgttctaatcctgtcaaccagtgcaagtgaccgacaaaattccagttatttanttccaaaatgtttgggaacagtttaatttgacaaagaaaaatggaaacttccccttttttggcggtccaccaaatacaaatcaaatgccttttggtttaattttttaccaaattccaattt

SEQ ID NO: 45065 - DNA, 730 bp, Homo sapiens
acacagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggatggtgacaacatgctggagccaagtgctaacatgccttggttcaagggatggaaagtcacccgtaaggatggcaatgccagtggaaccacgctgcttgaggctctggactgcatcctaacaccaactcgtccaactgacaagcccttgcgcctgcctctccaggatgtctacaaaattggtggtaatggtactgttcctgttggccgaatggaaactggtgttctcaaacccggtagggggggcacctttgccccagtcaacgttacaacgggagtaaaatctgtcgaaatgcaccaagaaaccttgagtgagcccctcctggggaaaagtgggcttcaatgtcaaaaagtgtcgtcaaggtgttcgtctggaaccttccggg

SEQ ID NO: 45066 - DNA, 628 bp, Homo sapiens
ggtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggctttgagaatgtaactgatctgcagtggctcattctagatcacaaccttctagaaaactccaagataaaaggggagagttttctctaaattgaaacaactggaagaagctgcatataaaccacaacaacctgacagagtctgtgggcccacttcccaaatctctggagggatctgcagcttactcataacaagatcacaaaagctgggctcttttgaagggattggtaaacctgaccttcatccatcctccaagcacaaatc

SEQ ID NO: 45067 - DNA, 316 bp, Homo sapiens
agtagagttgcttagttttgagcaatttagggcttttcttattggccagtaggctattcattttgctgctaaatataatttacgagggtaattttaacattatagttgctggccacttggtatctatgattacctaaaaatctagtttttatcctccataggtagatgtgtgtgtatgcatacccccacacacacacgtacatatatgttgtcatagagaggtatttccacccctatctccagataacagtagaagatacgcacatggatttatatttagttaaaatgtcattcatcccctctgttttcccttbgg

SEQ ID NO: 45068 - DNA, 309 bp, Homo sapiens
gatccatctaaactggagtgatgttagcagacccagcttagagttcttctttctttcttaagccctttgctctagaggtagttctccagcttcagctcaactcacagcttctccaagcatcacccagggagtttcctgagggttttctcataaatgagggctgcacattgcctgttctgcttcgtagtattcaatacccctcagtattttaaatgaagtgattctaagatttggtttgggatcaataggacagcatatgcagccaaccaagatgcaaatgttttgaaatgatatgaccaaaattttaag

SEQ ID NO: 45069 - DNA, 352 bp, Homo sapiens
gttaaagttttttttcctcattgtattcatagacaaatttttttcaatatattttgcaagaaaaatctttgaataagactaactgcatttaaaaggaataacctccttctgcctttccccaactacaaaaatgtttggcaactttgtgtttacatttaaagatcatttgcacctttttcaaggaaaaacagtattgagtagacagttgtttacatatatcatttatgcttttgtctagcatgtataacttttttaaataaagggtagtatttaccattaagaaaattttagctaatgctttttatcctgtacttttgttatttaatttggcatttctgtttctatataatgb

SEQ ID NO: 45070 - DNA, 267 bp, Homo sapiens
accactgtaacagtattaagaggtgagacctttaagaggtgatcagatcatgagggctctgccattatgaatggattaatgcatttatcttgggagttgattccttataaaaggacaatttaggccttcttttgtctctcatcctctcttgccttccaccttccaccatgggacgaggcagcaagaaggccttcaccagatgccagaccctcaatcttagaatccctgcctccagaactgtgaggacatagatttctgttctttata

SEQ ID NO: 45071 - DNA, 304 bp, Homo sapiens
gtggcaacccagctgttcattggaggtgtcactggatggtgcacaggtttcatattccagaaggttggaaagttggctgcaacagctgtgggaggtggattttttctacttcagcttgcaaaccatactaggtacatcaaagttgacttgcgacgagtggagaaggacatgaagaaagccaaagagcagctgaagatccgtaagagcaatcagatacctactgaggtcagagagcaaagctgagagaggttgtgtcactttttgaagaagaatgttctagtaacttggggatttttcggaggct

SEQ ID NO: 45072 - DNA, 182 bp, Homo sapiens
  misc_feature 36: n = A,T,C or G
gaaaaaggttttcatctccggtttacaagactggtntattagtttatactacaagggacaggaccattttgagtattttgttttcaattagggagatagttcgtattaggattaggattgttgtgaagtatagtacggatgctacttgtgcaatgatggtaaaagggtagcttacttgttgc

SEQ ID NO: 45073 - DNA, 163 bp, Homo sapiens
tggttgagagtgcttatgaggtgatcaactcaaggatacacatcctgggctattggactctctgtagcagatttgcgcagagagatataatgaagaatcttaggcggggtgcacccagtttcgcaccatgattaacggtctttacgggataaacgctgatagt

SEQ ID NO: 45074 - DNA, 463 bp, Homo sapiens
tatcacagtttagaagtagagttcctcagagttgtatggatagtcttaatgggtttttcctccgttttgctcacataaacttgtttatgatgtgaattactaaatcccaaccctaattttgagttttgaaagttagtatttttgtttagctatcgtattttcttagtgcaaggtttactaatagtggtgtattctacactagtatcaggagtaattagcatgcagtcatcatgacatagcaatgaaatgattggatcgatctacacaaagagggactagtattatggtgtcagtattgaaacagtgtgtaacagcaagccatttataatgtcaccagggagatatatctggtacgcatttgcctcctttgtaaatagatcagccaataatttttacaaaaataaaagactagaatatggggttgtcaaacagcaaataatttagagtattatctgtaatattt

SEQ ID NO: 45075 - DNA, 281 bp, Homo sapiens
caagatggtgccaccggtgcaggtctctccgctcatcaagctcggccgctactccgccctgttcctcggtgtggcctacggagccacgcgcgtacaattaccttaaaacctcggggcagaagaggagaggaggatagcagcagaagagaagaagaagcaggatgaactctaaacggattgtccagagaatttggcagaagatgacagcatattaaagtgagtgaccctgcgacccactcttttgaacagcagcggatggataaagctccctgtgttgtgtg

SEQ ID NO: 45076 - DNA, 408 bp, Homo sapiens
taattcctctttgagcggcatgacagcagagctcagagatcttcttgcatttctacagaagatgcactggctgccctggggttgtatctttcacaacaaagagtctttttcaaggacaggccagaggttagggagaggactgtcaatcccagatttggcactgtaaataggcattagctgtcctctaaatatatatatatatctcagagcatacccgtgtgctcaggggttagtaattaatgagaatgctaggagagctgatgaaaaagatacaactgctttcttaaaaagatttcagcacacatatattatgggggtactcctgctaattaataagacttttacatcatagagagaattacctccctggggagttcacacaaagttgttcctaaggtggataaatac

SEQ ID NO: 45077 - DNA, 315 bp, Homo sapiens
caaaaatagcattgcatacatggatcaggccagtggaaatgtaaaggaggccctgaagctgatggggtcaaatgaaggtgaattcaaggcttaaggaaatagcaaattcacctacacagttctggaggatggttgcacgaaacacactggggaatggagcaaaacagtctttgaatatcgaacacggcaaggctgtgagaactacctcttgtagagatttgcacccaatgacattggtggtgctcatcaagaattttgtgtggacggtggccctccttttctttttataaaccacactctatcttatatcccaca

SEQ ID NO: 45078 - DNA, 311 bp, Homo sapiens
tccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgcccttttggaaagggtttggacaaagacatctcggcagtcaggggcaaggactctttgaggagagttagcccacgtataggctctgccacgatggcgtcacatacctcatactgtgtatgctttaagcacct

SEQ ID NO: 45079 - DNA, 260 bp, Homo sapiens
attgtttgcaatacaaagctggataataacttgtgaagggaagaaagacagtcggttttcccatttgaaagttggaaaccattcaaaatacaagtacttgttgaaccttaccacttcaaggttgcagttaatgatgctcactttgttgcagtacaattatcgggtttaaaaaactcaatgagatcagcacactcgggatttctcgtgacatagagctcaccagtgcttaatataccaggatataatctgggaggggcaga

SEQ ID NO: 45080 - DNA, 362 bp, Homo sapiens
ccgaaagcgaagaaggaagctcctgcccctcctaaagctgaagccaaagcgaaggctttaaaggccaagaaggcagttttgaaaggggtccacaggcacaaaaagaagaagattcccacgttaaccacctttcggcggccgaagacactttcgactctccgagatcagacccaaatattctctgggagagcgcctcccccagagagacacgctttacccactttcctttctcaagtgtcccctgatgcaccccatgtgtcccaccaagaagagagaagacaacaacacacttgtgttcattgtggaggattatagacgacaagcagccaccttatacaggctgtaaggaagctggatgacta

SEQ ID NO: 45081 - DNA, 271 bp, Homo sapiens
tcctcttgtgcgaaattccggatttccttgggtcttcccgtaggggctttaataaattgtgctgacaacacagggagccaaaaacccttatatcatctcccttaaggggatcaagggacgggctgaacagactttcccctgctcggtgtgtggggacatatgtgtatatggcacaaaacacagagagggcacaccagagctcagagaaaaggggcatcacggcagtgggggattgggacaacacgagggataacccagaagagatggcgcg

SEQ ID NO: 45082 - DNA, 400 bp, Homo sapiens
cttgatattgttttcctgattgctaaatcaaggctgtattctagagaactgcaactaaggcaagttcaagtactgagtcaacaacaaaggataattgagacaatggagaattaagcctcaacccaatagtaatagggatataacactattgtaaaaaattagggttaagggcccccctttaaacacacaattggattcggagggaatctttcttatgttgaactcaaactggggtcaaaaatcacccccatgaagaaaaaaaattttcacccaaatgaactcaatgttaatttgctgatttaaaaaggggatttgtcccccctaggggtggggcccggggggattcccccactgacacgggttggacaaaacaaaatttaaaaaaaaaccccttcccccc

SEQ ID NO: 45083 - DNA, 411 bp, Homo sapiens
ccgagatgtctcgctccgtggccttagctgtgctcgcgctactctctctttctggcctggaggctattccagcgtactccaaagattcaggtttactcacgtcatccagcagagaatggaaagtcaaatttcctgaattgctatgtgtctgggttcatacatcccacattgaaggtgacttactgaagaatggagagagaattgaaaaagttgagcattcagacttgtctttcagcaaagacttggtgtttctatctcttgtactacacggaattcaccccccctaaaaaagatgagtattctcccctctgaacaggtgactttgtcacagacccaagatagttaaggggggtcgagacatataagcagcatcatggggggtttgagaagccgcctttgattggtgaattc

SEQ ID NO: 45084 - DNA, 231 bp, Homo sapiens
attttaactgagaattgattatatatagctctaagtatataggtatttaaacaaccccacaagcggctgtatcagtaacatttattaattccactatagtgagggaggatttcctttctaaatacctattttgagggattataaacctaggtgtaaagaggaagccacatgggtgggataaatttcctcagccattttgggatttgagggcaccatgggagggtgtttatg

SEQ ID NO: 45085 - DNA, 180 bp, Homo sapiens
aactgaaatatagagaaatacaaataagcaaagaaggaggaatattcaaaatgttcaggatggccaaagcaatagacttaaggatgatctagaagagagagaaatctagctgacttgtgttttctcacatcctcctacaatcttgaggaggaggtttaggcaaatacccctaaggtggtt

SEQ ID NO: 45086 - DNA, 201 bp, Homo sapiens
ctgcagaagatgtcaatgttactttcgaagatcaacaaaagataaacaaatttgcacggaatacaagtagaatcacagagctgaagggagaaatagaagtaaaattgaaacaactccaaaacctaggaaggatgcttgtgatgacatcatgcttgcagatgatgattgcttaatgatacctatcaaatgggggatgtcttc

SEQ ID NO: 45087 - DNA, 331 bp, Homo sapiens
tacagagagctgtgtgcatgctgagcaacaccacgggcattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgagggaagaaggagagggatactaaagttaaaacgtcacacaggtgctgcttttacagggaagcttattctcttttaaacattttaaaagttgtggtcttatcagattaa

SEQ ID NO: 45088 - DNA, 481 bp, Homo sapiens
  misc_feature 448: n = A,T,C or G
taaatcatctttccaatccagaggaacaagcatgtctctctgccaagatccatctaaactggagtgatgttagcagacccagcttagagttcttctttctttcttaagccctttgctcttgaggaagttctccagcttcagctcaactcacagcttctccaagcatcacccttggagtttcctgagggttttctcataaatgagggctgcacattgcctgttctgcttcgaggtattcaataccgctcagtattttaaatgaagtgattctaagattttgtgttgggatcaatagggaaagcatatgcagccaaccacgatgcaaatgttttgaaatgatatgaccacaattttagtaggggagtcaccccacacttctgctttcacttaagtgtctggccgcaatactgtagggcaagcatgatcttgtaactgtgatattttaatnatcccagtactaactttctccaaatgatcccgt

SEQ ID NO: 45089 - DNA, 183 bp, Homo sapiens
tatgttgtcttttgtttaagcatttattttcaaacactaaggagctttttgacatctgttaaacgtctttctgtttttctgttaagtcttttacattttaatagtttttgaagacaatctaggttaagcaagagcaaagtgccattgtctggctttaattggggggttggaagggaaagaggg

SEQ ID NO: 45090 - DNA, 181 bp, Homo sapiens
tacatttttatattctccttttgacattataactgttggcttttctaatcttgttaaatatatctatttcccccaaaggtatttaatattctccgccccctgacaacttagatcaactattttaagcttggaaaatctctctaaacacaattgttatagccagaggaacaaagatgatata

SEQ ID NO: 45091 - DNA, 107 bp, Homo sapiens
gtcatgtgagcctcgtgtcatctccggggtggccacaggctagatccccggtggttttgtgctcaaaataaaaagcctcagtgacccatgaaaaaaaaaaaaaaaaa

SEQ ID NO: 45092 - DNA, 481 bp, Homo sapiens
ttgaaaggcactttcatttaaacataaacctggagtactcgaaatagaattcaggtttacaagatgaaagcgtgtggagaagtgtcagatggcagtggaagcatgtgtgtttctaaaaagtaaaaatctctagaaaacagaaatggcatgctttacccatctgacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataccacccgttggggggagttgatgaattcctgttaaaagctgttcttgtgtgttacatgtaacagacatggtaaatatttgtttacaggctttgtttaacaaaccatgcatttgaggttgaggggaggccaacaaagggaattggggtttgggatgtgatttg

SEQ ID NO: 45093 - DNA, 150 bp, Homo sapiens
tgtctcgctccgtggccttggctgtgctcgcgcttctctctcttttctggccttgggggcttttcccgcggttcctccccgggtttctgggttttctcccgtcgttccggcggtggtattggaaggtctctttttcctgacttgcctctt

SEQ ID NO: 45094 - DNA, 180 bp, Homo sapiens
tcatatcagcataatttgcaattcttagaaattggaaataatccagatgtttattagtagaggaattataaataactgtgacatacttataaatggaatattaaagaacaataaaaatgaacaggctacaattagatttacacacatcaacatagaagtagctcatattcacaatgttga

SEQ ID NO: 45095 - DNA, 211 bp, Homo sapiens
cttctgctgagggggcaggcggactttgaggaaaccgcagataagtttttttccttcttttgaaagatagagattaaaacaaacttccttaaaaaatataggtcaatagggatacctaagagatttccttagcggttaaggttttaaccgaaattttaaaattgcgttaagagtttaaagagaaaaatattgaaggccttagaagatgtag

SEQ ID NO: 45096 - DNA, 246 bp, Homo sapiens
caatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctcgaacaaatatatttatggtgtatgtgttttctgtgtgtcagattttcatagtatccatatttta

SEQ ID NO: 45097 - DNA, 256 bp, Homo sapiens
acttcgctcgtactcgtgcgcctcgcttcgcttttcctccgcaaccatgtctgacaaacccgatatggctgagatcgagaaattcgataagtcgaaactgaagaagacagagacgcaagagaaaaatccacttccttccaaagaaaccgattgaacagggagaagcaagcaggcgaatcgtaatgaggcgtgcgccgacaatatgcactgtacattccacaagcattggctctcttattttactttcttttagctg

SEQ ID NO: 45098 - DNA, 260 bp, Homo sapiens
  misc_feature 228: n = A,T,C or G
ttacacagaacattggtttccaatttagtttaactgaaatttgctgctgatatgttgagtttgttctttaaaaaatacctcatatatctcgtctttcctccttagaagaacagacctaactagcgaatgtatgaatgaaaatgcatctatttcagagccgacatgaagagtttagtttttttactttataaactgtgaatatgagtatgtcagctgcattagatgtanactaatcatatttaaatatatacccacatttt

SEQ ID NO: 45099 - DNA, 161 bp, Homo sapiens
ggaggttgcagtgagccgagacggcgccattgcactccagcctgggtgacagagtgagactacgtctcaaaaaaaaaaaaaaacggaaaaggtaggattaatggctgggccggtgggctaaggccttaatcccagcacttgggaggcccaggccagtggat

SEQ ID NO: 45100 - DNA, 278 bp, Homo sapiens
caaaatggagctcgaggccatgagcagatataccagcccagtgaacccagctgtcttcccccatctgaccgtggtgcttttggccattggcatgttcttcaacgccttgggtcttcgtttacggggtcaactttaccaagtacatttgcgatatctataaagagcttctctatctctctctagtgtgcctcactcttcatggggctcttgtgagtctctctctcctctctctctctttggtgtgtgcatactaatcgtgttgtagacaccccaagggg

SEQ ID NO: 45101 - DNA, 265 bp, Homo sapiens
caaagaagggtggcgagaagaaaaagggccgttctgccatcaacgaagtggtaacccgagaatacaccatcaacattcacaagcgcatccatggagttggcttcaagaagcgtgcaccttgggcacttaaagagattcggaaatttgccatgaaggagattggaactccggatgttcgcgattggacacacaaagtttcaacacagtgtgtctcgggccacagggaatatgggtgtgtgtccaaaacgcgattcgctgtgcggct

SEQ ID NO: 45102 - DNA, 251 bp, Homo sapiens
gtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaaggtgttgtaacctgctgtgatacggtgcttcaagagaaaatgcggttataaaaaatgggtcaga

SEQ ID NO: 45103 - DNA, 233 bp, Homo sapiens
ttcatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctggacagaagatgtgcaggcttcagtatcagacacagcacagcagccatctgacgagcaaagcaagtctcttgaaaaccs

SEQ ID NO: 45104 - DNA, 240 bp, Homo sapiens
aagaattaacgaaagcagtgtcaagacagtaaggattcaaaccatttgccaaaaatgagtctaagtgcatttactctcttcctggcattgattggtggtaccagtagccagtactatgattatgatttacccctatcaatttatgggcaatcatcaccaaactgtgcaccagaatgtaactgccctgacaggtacccaagtggccatgtactgtgatgagctgaaattgaaaagtgtacc

SEQ ID NO: 45105 - DNA, 245 bp, Homo sapiens
aacatatgacgcactctcccctgaactctacacaacatattttgtcaccaagaccctacttctaacctccctgttcttatgaattcggacagcatacccccgattccgctacgaccaactcatacacctgctatgaaaaaacttcctaccactcagcctagcattacattatatgatacgtctaccataacccattaacagtagtcagcatagcccctcaagatctgtaaacaaaacactagaas

SEQ ID NO: 45106 - DNA, 335 bp, Homo sapiens
gtaatgtcgataaagaggaggaagctgttaccatagagatgaatgaaccagttcaactaacttttgcactgaggtacctgaacttctttacaaaagtcactccactctcttcaacggtgacactcagtatgtctgcagatgtaccccttgttgtagagtataacattgcggatatgtggacacttaaaatactacttggctcccaagatcgaggatgaagaaggatcttaggcattcttaaaattcaagagaaatacagactgagctctattgagagactcgcttctcagatgacagcatatagcttaagtcttttctgtcacctcaatatagta

SEQ ID NO: 45107 - DNA, 237 bp, Homo sapiens
gggctattttagatgcttttaacctccccaacaaataatttgccaagtgtccaatgagaacttatcatgttggtgtgttaggtaaatcgggcaaatatgatagtgtcttacattgggccttgattttaagctgttatatttgtacaatcgagtattttaggaattacatgacacatgacacagtttttgcaattttcgttaaacttggcatctatgcttctgaaaagtttactttga

SEQ ID NO: 45108 - DNA, 198 bp, Homo sapiens
agaatgtttgtcatatgcttcttgccaatgccatattttacgaatctcaaaccgtttccaataaaacccatttttccagatataaaggggaattccttccaaattggagtaattccagaaaagctccaagatttaagttaaaaagtggattggcctttggaccaagactttataccccttttaatcgtaccacagtgm

SEQ ID NO: 45109 - DNA, 237 bp, Homo sapiens
gaggacacttatctctttcagtggtcctcccaagaaattatttaacaaactgaaaggagattttgattaaaattttgcagaggtcttcagtatctatatttgaacacactgtacaatagtacaaaaaccgacataggttgggtttctagtatgaaagagcaccctctagctccatattctaaggatctgaaataatgctactatactaattaataaggaaacctcagggggttaaaa

SEQ ID NO: 45110 - DNA, 290 bp, Homo sapiens
aagtattctacattctatgaccacatgtacacattatttagctcccacttataagtgaaaacaggcagtatctgactttccgttcctgtgaatctcaagtcttatcactatacacaaaattatactatactcaaaatgtattataaaccctaagcataaaagtgtctatattttctaaagcaaatacagcagcaagtctttgtgattttggaatacacaaaggtttatcttgaaccataaaacaaaaatatcggacacaatgggcttaatcaaaattaagaacgtcttgg

SEQ ID NO: 45111 - DNA, 279 bp, Homo sapiens
atggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagcaagcattcaggattccagaactctgccattcaaaactcatccttctcaggcttcattttgttctgcggtagggtgagaagatgattgtataggacactcttat

SEQ ID NO: 45112 - DNA, 193 bp, Homo sapiens
tccctggaaagtaaagggaagtaacccactattgattttggccttaaaatttttctatgataaatattcaaaaaggtgtaaccgttttatcttctccaaaatgaggtttgatagtccctcccacactttgaagtgtaggggggttcgcgggtcccctcctagtgggggaggtcgtttaaatggagatcccttt

SEQ ID NO: 45113 - DNA, 280 bp, Homo sapiens
taaaatcaaaattgctgggcaggtggccaagcctgtcatcccactatccgggggctggggcaggaatcgattgaactgggaagtggagttgcatgagcggtgaacgagccatgcactccagcctgggcaacagagcgagactgttgtctcaaaaacaaacaaaaaagcccaagaagcacatagataacatggtttcactgttgtaacattgtatctgtactttgctacacatggataagtagctataattgtttggacaagcttttgctacaatgtttgc

SEQ ID NO: 45114 - DNA, 295 bp, Homo sapiens
taaaagagggatagcatttgtaccatatcctctctacatctccagcaggtgcagctaaagaaatatcacgtttttcttgttgaacccaaagtgggcttcagaacccttttcaacacagagctccaggcaaccattcatgatcaactgaggtgacacatgacatgaaatctatttgtcattatgtcttcaaaaacacttccaaagcatattcattaaagcagaattctccaaacatgtcacgttgaaagacagtcatagctgcagagttcacaatgattacaagcatattagactc

SEQ ID NO: 45115 - DNA, 292 bp, Homo sapiens
tggaggccaaagaatgaaatttctgggacactggaagatgattttcttaaggctaaatcctggaataaaaagttctatgattatgaagcaaacatgccagacagatggggtcacagtggttataaagagttataccctgaagcatttgaaacagacagtagtgatcagcaagatattaccaacggggagtaaacatcttcccaggtaaagtcatctacccatgaatgccgcaaacacaaggagtcaaagcaatcccacaaaaaacagcaggaaaacaggtcacacaaacacc

SEQ ID NO: 45116 - DNA, 295 bp, Homo sapiens
tggctagtgaaagagacctttacctcacagtttcagttttattataaattgcccattagtgcattagaaacaaagtgaaaaagtgagaattgtaactattcttttattctatttgttctaatcctgccactgaatttttttcaacttttttttaatatatgacctcagtatgacagatgttcgggaaattgaatacaatattggttaaggtgtcagggatagcatgatcttcaaatattcatttctcgtgacttcaaaacttgaacacaggctcacacgsgttttgaggtaagcg

SEQ ID NO: 45117 - DNA, 291 bp, Homo sapiens
tacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttccctatttcttgaacaaaggctttgtctgaatgatgttcttttatctcttgaaccaa

SEQ ID NO: 45118 - DNA, 298 bp, Homo sapiens
tcctgaagctgacagcattcgggccgagatgtctcgctccgtggccttagctgtgctcgcgctactctctctttctggcctggaggatatccagcgtactccaaagattcaggtttactcacgtcatccagcagagaatgggaaagtcaaatttcctgaattgctatgtgtcttgggtttcatgccatccgcacattgaggttgacttactgtaggaatggagtagagaattgaaaaagtggagcattcagacttgtctttcagcaaggactggtctttctatctcttgtactacact

SEQ ID NO: 45119 - DNA, 296 bp, Homo sapiens
ctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattggggctaactttgctgctaggagttcaagccatgcctgcaaatcgcctctcttgctacagagagatactgaaaggtca

SEQ ID NO: 45120 - DNA, 291 bp, Homo sapiens
cccgagagtaaatcatctttccaatccagaggaacaagcatgtctctctgccaagatccatctaaactggagtgatgttagcagacccagcttagagttcttcctttctttcttaagcccattgctctgggaggaagttctccagcttcagctcaactcacagcttcttcaagcatcaccctgggagtttcctagggctctctcataaatgagggctgcacattgccgttcttcttcggaggattcgatacccctccagattttaaatcgagggactcctaagctctcggc

SEQ ID NO: 45121 - DNA, 176 bp, Homo sapiens
tctaacgcttaaatcatgtgaaagggttgctgctgtcagccttgcccactgtgacttcaaacccaaggaggactcttgatcaagatgcccaaccctgtgatcagaacctcgaatactgccatgagaaactagagggcaggtcttcaataaaagccctttgaaccccattcctgccc

SEQ ID NO: 45122 - DNA, 234 bp, Homo sapiens
tgtcgttggaagagtacagctgatcctgtccacagacaccttggaagagcttaaggaaatagataaaggcatgtggaagaaactgcaggagaagtttgcccccaagggtcctagaggaggatcataaggctgagctcaggccttacctcgtgcacatacctaggtgtggagtcttgtacattgccatcgtcaataaaactgccccagtttacccttgaaaaaaaaaattatatc

SEQ ID NO: 45123 - DNA, 249 bp, Homo sapiens
ctatgtaaaatttttactaatgtcattattttgaaaaaataaatttaaaaatacattcaaaattactattgtatacaggcttaattgttaatattccctaaacacaattttatgaagggggaggacattgggtttgttgacattaacagtacatcttttcaggttctcagctatttcttctacctctccctatcttacatttgagtatggtaaacttatgtcatctatgttgaatgtaagcttataaag

SEQ ID NO: 45124 - DNA, 243 bp, Homo sapiens
aaaaataacagatcacaggaatgtatctgagagtccaaacagaaaaaatgaaaaggagaagaaagttaaagaccataaatcttaacagcaaagagagagacatcaggaggggattcaggaaaaaggaggcaagtattaacacacagttgaggaaagggccatctctccagttgggtttgagccccgagagatcacagagtgtagagcagagattttacaacacatatatagatttagagacag

SEQ ID NO: 45125 - DNA, 217 bp, Homo sapiens
catacccatagagaagtgtgtaagtgatatgtcagaagagcttcttactgatttcacctaaaatgagaagggaggtcccgttttcaaggaatgacaatagggtcaagcagccttggggccctcgggtttatactgggataaattggaaagggaacacatgtctctatatttccctaaaatggaggaaacccccctagggtgtctacacatgggaggc

SEQ ID NO: 45126 - DNA, 269 bp, Homo sapiens
atatcttgataaactggagcccagcaagattacaaagtttgagaatgctttcttgtctcatgtcgtcagccagcaccaaggccttgttggggcactatcagggctgatggaaagatctcagaacaatcagatgcaaagcttgaaagggattgtaacaaatttctttgggttggatttgaggttaaacttccgtgtggattaccacaaatataccagtaaaggtttgtgacatgtgtctcgggtaaagtgggtcccatgtgataaggggg

SEQ ID NO: 45127 - DNA, 217 bp, Homo sapiens
aaaataaaagatcaatattatcataatgctatcattctgctaaacgggcccaaaacagtaggaatttctgctcatgtcctagcagggttcaggaggactgcagccaagttcagatgtaaaaacaaggaggaggaactttttccaagggaaaccacaaaacaaattgggaaaaggttattggcccgctttcacccttttttatactttatttcacaca

SEQ ID NO: 45128 - DNA, 147 bp, Homo sapiens
gagtgcttcatgcctttagatgtacaggctgacagagaaagattcccgagagtaaatcatctttccaatccagaggaacaagcatgtctctctgccaagatccatctaaactggagtgatgttagcagacccagcttagagttcttc

SEQ ID NO: 45129 - DNA, 200 bp, Homo sapiens
atccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttcaggcctcatttgcaattcatgtaacaggtgtgtcataaattaca

SEQ ID NO: 45130 - DNA, 184 bp, Homo sapiens
acccctcccctgctgttgtaaatactgtaattattggagaatttaaattattctcatttgtaactgcgtttccgggtcgcgccagagtcatttggtacccaaaaaaaaaaaaaaaaaaaaaaaaaaaaaaatgggggcccccccgcccaaggggtttttgggttgggaaattttaaaagggggg

SEQ ID NO: 45131 - DNA, 190 bp, Homo sapiens
ctaagagagggtctgtgtgactgactcctaatgaaataatttaaatctctgaatctaggcatgcctgacatcacctaatactgttttatttttttaaaccactatgcaatcaaggtattctatattttgcttaaggcattgtgggtggtgcctctcacaattacaacaaaagggcatataacttttatat

SEQ ID NO: 45132 - DNA, 237 bp, Homo sapiens
  misc_feature 209: n = A,T,C or G
caacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcngacatatacaggtgtgtacgtaggtgta

SEQ ID NO: 45133 - DNA, 201 bp, Homo sapiens
ttcataacatcgtcattttgggttatgcgaaatacaaatttaaatctttgtgaaatgaaagaaaagaggaagaaacgctttttaggagttaaggattaaagtaaaaattattttgacataattacctctttttgtgaccactcttaaaggccaggaacatatttggagaagcctagttgtatgtaacagtgtggggtttca

SEQ ID NO: 45134 - DNA, 150 bp, Homo sapiens
tgtgagtcttttcagcaacccggtccagtactgggagatacagccatccaccttcagatgtgtctacgtgcgctctgccattcaactcggaaactataagtaattctcaaggaaggcctcatttttataaccttgccaaatcttgttaat

SEQ ID NO: 45135 - DNA, 226 bp, Homo sapiens
ccagtggaaatgtaaagccggccctgaagctgatggggtcaaatgaaggtgaattcaaggctgaaggaaatagcaaattcacctacacagttctggaggatggttgcacgaaacacactggggatggagcaaacagtctttgattatcgaacacgcaaggctgtgagactacctattgtagatattgcaccctatgacattggtggtcctgatcaagaatttggta

SEQ ID NO: 45136 - DNA, 211 bp, Homo sapiens
caggcggaattgaggaaaccgcagataagtttttttctctttggaaagatagagattaatacaactacttaaaaaatatagtcaatagggtactaaggtatttcttagcggtaaggttttaacgtaattttaataggcttaggatgtttaagagaaaatataaggacttagaagagaagcattaggagggaaaagagtaaaggtttctata

SEQ ID NO: 45137 - DNA, 141 bp, Homo sapiens
tcaagacagtaaggattcaaaccatttgccaaaaatgagtctaagtgcatttactctcttcctggcattgattggtggtaccaatggccagtactatgattatggttttcccctatcaatttattgggaattaataacaaa

SEQ ID NO: 45138 - DNA, 123 bp, Homo sapiens
atccccgacagttttgcagaacactgaaatctatggactctaaaatggacttcatttaaagaaacccacggaccattaatggacaaaaacatgagtcaatatgtattgtgggcaatcaaatcc

SEQ ID NO: 45139 - DNA, 168 bp, Homo sapiens
taaataacgaaattaaggcagaaataaataagttctttgaaaccaatgagaagaaagacacaacgtaccagaatttttcgggacacagcttaaagcagttttttagaggggaattttttggcacttaaatttcccttgggggaaaggcgggacccttctaaatttgta

SEQ ID NO: 45140 - DNA, 240 bp, Homo sapiens
tacatttaaatcctgttggctcagataaggtgaatggacagtcactgggaaactgggatcagaaaggggaatgcacaaattataccttgaaggtgatgaatctgactcattgactgattatgatatggtagggggaaaagagagcttcactgcatcattaaaatttgatgacagtggcagttggagaggaagacaggaagagtatgtaactggacaggattttcactccgatactgatca

SEQ ID NO: 45141 - DNA, 221 bp, Homo sapiens
cacgagcatcggccatgcctttcttggacatccagaaaaggttcgggcttaacatagatcgatggttgacaatccagagttggggaacaggcctacaaggtggcttgtcgatgcccatctttttaaaaaaggattggaagatttcgcacatggattcggtgatactcgggcagagaaggagtacaagatagactatgtatgtatctcggggagtgtttcgc

SEQ ID NO: 45142 - DNA, 132 bp, Homo sapiens
ctttgaaaaccatttatagtttgaaagtgtaagtgattccttcgttattatttatgcatgttcatgaacttctgctgtacaatggaataggagttaacacattcacaattactggctatttccttgtgtgcc

SEQ ID NO: 45143 - DNA, 331 bp, Homo sapiens
ctgcctgcggaacggaccgtgtgggcctggtccttcttgccctactggccgcctttgaggtggtggcatttgtgttttgggtcccataaaagaataggtcttttgcccttttaccttccttaacaggagaatgcacaaaccttcttatcccctccgcagcgatggagcgcttggtacccgagaggatcagcggcgatctgtgcctgtccgcgcgctccttggaaagcctttggtgtctcagactttgcgcgcgctcgcctggatatggatccaagctgcctctgtcgatcttcaggtgcgccgggggcccctgagactaggggagggcaaa

SEQ ID NO: 45144 - DNA, 440 bp, Homo sapiens
ccaaagctaagacccccgaaaccagacgagctacctaagaacagctaaaagagcacacccgtctatgtagcaaaatagtgggaagatttataggtagaggcgacaaacctaccgagcctggtgatagccggttgtccaagatagaatcttagttcaactttaaatttgcccacagaaccctctaaatccccttgtaaatttaactgttagtacaaagaggaacagctctttggacactaggagaaaaccttgtagagagagtaaaaaatttcacacccatagtaggcctaagagcagccaccatttaagagagcgttcaagctcaacacccactacctaaaagatcccaaacatatacctgaactcctcacacccaattggcccatctatcaccctttaggagagctcatgttagtataggtcacatgagaacattctcc

SEQ ID NO: 45145 - DNA, 359 bp, Homo sapiens
tacccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttactgttgccctttcaaattatcttctccacgaggtggagatgaagagaaaagaccacccattttgtagagggttgagatgcttgcaacaggggaggaccacatcaacaggcttattagaagcatgatctatggtgtctaccccgattattttcctaagctgggtggggt

SEQ ID NO: 45146 - DNA, 260 bp, Homo sapiens
ccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaggcaagcaggcgaatcgtaatgaggcgtgcgcccgccaatatgcactatacatttccccaagctatagccttctcattttcacttctcttagctc

SEQ ID NO: 45147 - DNA, 110 bp, Homo sapiens
agttagtatagatacaagaaaatcgaagtgtttctgttttggagagtagatgatagttcagaaaaaaaaaaaaaaaaaaaaaaaaaaaaaaatggggcccccggcccaaa

SEQ ID NO: 45148 - DNA, 154 bp, Homo sapiens
cctacctctggcaaggaaatgctggaccataaggagtcttaaggcaaactagcctattatgagaatctaaccggtaacctgacagggggccaagggtaaaaaagctccaaaggtaaaaaaagttccctatggagatcaacgggggacccgtgag

SEQ ID NO: 45149 - DNA, 484 bp, Homo sapiens
agaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgagttgaacaggagaagcaagcaggcgaatcgtaatgaggcgtgcgccgccaatatgcactgtacattccacaggcattgcctctcttattttacttcttttagctgtttaactttgtaagatgcaaagaggttggatcaagtttaaatgaccgtgctgcccctttcacatcaaagactactgacaacgagggccgcgcctgcctttcccatctgtctatctatctggctggcagggaaggaagaactttcattttggtgaaggaagagtagggtggagaatttgggtggggcgccataaatttagggtaaaccccatggccccggagct

SEQ ID NO: 45150 - DNA, 232 bp, Homo sapiens
ataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctcccggtacggaaggacaagagaaataaggcctacttcacaaagcgcctt

SEQ ID NO: 45151 - DNA, 326 bp, Homo sapiens
aagagcgctcccaggagaaacaagcttgaccactatgctatcatcaagtctccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctcatggagagaagaaggcatatgttcgactggctcctgattacgatgctttggatgttgccaacaaaattgggatcatctaaactgagtccagctgcctaattctgaatatatatatatattt

SEQ ID NO: 45152 - DNA, 302 bp, Homo sapiens
caaataaaaacccaattcagtctcttctaagcaaaattgctaaagagagatgaaccacattataaagtaatctttggctgtaaggcattttcatctttccttcgggttggcaaaatattttccaggtaaaacatgctggtgaaccaggggtgttgatggtgataagggaggaatatagaatgacgactgaatcttcctttgttgcacaaatagagttttgaaaaagcctctaacaggtgtcttctttgacttaatgtctttaaaagtgtccagagatactacaattttcacataagacagtt

SEQ ID NO: 45153 - DNA, 129 bp, Homo sapiens
aatatcttctgatcgtcattcagaatccatgtgaatagacctgcgatggccaaggctgtttaagcgacactgggttggaaacacttggctctcttcatgaggtattaaaattctattttcaattctata

SEQ ID NO: 45154 - DNA, 111 bp, Homo sapiens
tcttgctaacataccacgttgtgagagaaatacatttgggaaaacaataaactaaaaagagatcccttcaggaataaccatgtagggtgaaatacctccagataatctttc

SEQ ID NO: 45155 - DNA, 130 bp, Homo sapiens
tctcgaagcccaatgcattacatgtataggccgagaagtcgaagtccaagaatttgccatcgtttcatttctagatacagatccagatccaggttccgttcaccatatcgggattaggacattccatttw

SEQ ID NO: 45156 - DNA, 201 bp, Homo sapiens
aaagaatttggtaccaacatcaagcttggtgtgattgaagaccactcgaatcgaacacgtcttgctaaacttcttaggttccagtcttctcatcaaccacctgacaattactttgcctaggcaccggtattttggaaagaattaaggaaaaccaggcaaaatcttcctcatggcttggccccacagagaaggagagatctg

SEQ ID NO: 45157 - DNA, 453 bp, Homo sapiens
agtcttgctggagaattgcttgaactgaaccagaggaggtatacatgtcatggttaagctcaggatgtaagggacacaggtcacaaacaggaaaggccatgagaagagaattagtacatctttattgacctcagcattcactgtgtttcttttgctgaggaaattgctcataatctggcataatttgggccagattctttattcttccttgagctaggcagaataatggaatacaatatgcctcataatataacaacactaatacactaatagaaagattaagttaggcaggcttctaccaaatggggaatggggatcgcctcaaaattgtgcccataatccacgctcatcttgcaaagcgctatttcagccatcattggaatacaggaagagccctgcacctgccagggagcccgccatcacctgagggaagagggacccgcatcctggaaa

SEQ ID NO: 45158 - DNA, 458 bp, Homo sapiens
ttttcaatgcctgatgacctataagaatttagtatggaaaagaagagagattagaactggggtgaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgacagacagaaattccatgtatgagctcaacaaagactacctttggctaaatgctagaagcagagaagtaaagtgagcaaaatccagggtgaggagcatgcaggactttgatctttatatactctgaagcatttcttcaactttctactttaattggcatggaacctgaggaggtggcaatggggggaaattcaaaa

SEQ ID NO: 45159 - DNA, 584 bp, Homo sapiens
gtgaagcatcataccaataatagtgtatcacagtttagaagtagagttcctcagagttgtatggatagtcttaatgggtttttcctccttttgctcacataaacttgtttatgatgtgaattactaaatcccaaccctaatttttagttttgaaagttagtatttttttttagctatcgtattttcttagtgcaaggtttactaatagtggtgtattctacactagtatcaggagtaattagcatgcagtcatcatgacatagcaatgaaatgattggatcgatctacacaaagagggactagtattatggtttcagtattgaaacagtgtgtaacagcaagccatttataatgtcaccaaggagatatatcttgtacgcatttgcctcctttgtaaattagatcagccaataatttttacaaaaataaaagactagaatatggttttatcaaacagcaaataatttagaatattatctgttatatttgctgctttttaagttaaatgcaatacttgtgtttatttccttttgaacttccccctccaagttcaaaatacagcctgatacaattacagggatgga

SEQ ID NO: 45160 - DNA, 377 bp, Homo sapiens
gaaaaatctaacgaactaactcatttatttctattaaaaaggtattgtcctttaggcggggagtgggactccttgctgcactgttgcagtcattctgaaaggacctttccctgtacgtacctttcaacatgcttcaatcttatcaacgctacattttgtatttttcaaacaagtataaattctgcaataaagagatgtagtttttttttaggattgagtttttgtttgttatttctgaatggttcatcagtatgttaactataccttttatctagaaggaaaatcaaatcaactataccttttatctgagaaggaaaatcactcactaagttttattcaggctcaccaacccccattaaaatctacgggttgggttg

SEQ ID NO: 45161 - DNA, 140 bp, Homo sapiens
ttggaacttctgagagtattacagagtggtagaatcggtaagaactctgatttggacttcgctttggtggaacttttgtgccctataacctcccttgtttttttttctaagtttgcaggggtcctttggtatggatttgt

SEQ ID NO: 45162 - DNA, 209 bp, Homo sapiens
tctttctttaggatacagagagtaactgtacctattatttgtttcttcagacaagcaaatcatttggtcagagttcatataatctgtctgttccctggaagattgggatagaggatgattgacaagtttattttcctccaattccccctttcctcacacaaatttgtattcacactctggtatatctcggggcaaagggcacgggggca

SEQ ID NO: 45163 - DNA, 411 bp, Homo sapiens
ttaattttctttggaattcaatgtggttgtgaatcaaacttaaggaaggaacgtttaaatagcaatgagatacagaattatgggcctttggaacaaggccgacttcccctaaattctccttaggtttgttaataccagtatttagaatcctgattcaatttatacacctgccccccatattggcagggacaatatgatactttaatggggataattctttgaggggggtctccagagtaaccctcagggctctccgagtgagttgtcacacacacacagggggttattgagacccccatcgctctagccgggtcatcatcaggatgcccacagaggagcctgacacacccccactggtgggcacccatccacacaccgcgcttctcttcgcgggggcatttggggtgtgct

SEQ ID NO: 45164 - DNA, 464 bp, Homo sapiens
cataaagagcttctgcaagatcctggggccattatcctactccaagatcaagcatttgcgttttgatggcaatcgcatctcagaaaccagtctttcaccggatatgtatgaatgtctacgtgttgctaacgaagtcactcttaattaatatctgtatcctggaacaatattttatgggtatggttttcggtgtgtcagggtcataggatccctatattgaatactgtgtaaatacactcccatgaatttaaaaactctggggaaattgttgtgaacaaatatttcccgtaagagaagatgggaaggcagggccctttcatcacaggagcacacacatatacacgcgtagacacacactcacaactctattggtaaaagaagagagggccactactctacaaggggaaacaacccctactacgggctcagtgtaacccccgtgatatcctcagagcagagtcccc

SEQ ID NO: 45165 - DNA, 286 bp, Homo sapiens
tgaagggggagcagctttgtcagatgacaagagagggaataagagagggggcaggtgccatattctttaaacaattagatctcacaataactcatgaccacagggagggcaccaagccatttatgagggctctgaccccatgacccaagcatcttccactaggcccaccaacaacaatgggaatcaaatctcaacaggagatttagagggtataaataccccaaaccctataaagcgaagcacacataaacacatgtttgcctctttatacacacatttcacacat

SEQ ID NO: 45166 - DNA, 411 bp, Homo sapiens
ttaatggaataagtttaacaaatgcttagaattttgcatctatgtagaaatactgtaactttttttctgcttgaatctcttaatgtggtgaagaactggtaccaattctactgaaactattcaaaaaatttgagggggaaggactcctctccaactcattctataaagccagcatcaccctgatcccaaaatctggcaaagacataatgttaaaaggaaggctccaggccaatatctctgatgaatggattggccaaaaatccccccaaaatcctgccacctgtttccggggcactataaaaggtgatccctctagtccagggggttcacatcccgggtgtgaggggggtcacccacacccacccgctgaagggggttcctccccctgcccgtttatatcccacccctgtt

SEQ ID NO: 45167 - DNA, 162 bp, Homo sapiens
aacatcgagcagatttttaggtctttcgtggtcagtaaattccgggaaattcaacaggagctttccagtggaaggaattaaggccagctgaattgtgaaacaaatacacccattgaaggaaaccaggcgggtgatgcagctgcctctgacaggagtctatcc

SEQ ID NO: 45168 - DNA, 240 bp, Homo sapiens
aaatgcaaataccttcatatcccctcagcagagatggagagctaaagttcaaggaggaggattccaggaacggctctaaggccttgtccaagagcttaataaggaaggctttttatgtactacaggcttttcggacgcgtacggcaaatggttattgggtacacatgtctgtgctatatatcgcgtatctctcaggggagcgcccgcgggggacacattgtagactctagtgggagagaa

SEQ ID NO: 45169 - DNA, 152 bp, Homo sapiens
acagattctagtgctgagaagaaacacgtttggtttggagagtccatggatggtgggttttcagtttagctacggcaattcttgaactttcttaagttgttcttggatgttacaggttgcatttcttcgacttcttttcacccgagctttcc

SEQ ID NO: 45170 - DNA, 147 bp, Homo sapiens
acatggcttgcagtgtgtgcaggcataacttctgatgctaatgttctgactaatgaactaaggctcattgctcaaagggtatttattccagtatcaaggggcccatccccctgtgggcaggttggtacagccctgtgtgtatatcam

SEQ ID NO: 45171 - DNA, 152 bp, Homo sapiens
cccaggaaggaatgaaaactcctctgatgtggttggggggtctggcagctggggccctcccggtcggcaattggcaattttttttccaccctggggttcttcagacaagtgctttatgctgagcaaggtcaataaaggttcttggggaggtt

SEQ ID NO: 45172 - DNA, 215 bp, Homo sapiens
aaacgctgaaagccatccactatgcgttgaactgctgtggtttggctgggggcgtggaacaatttatctcagacaactgccccaaggaggacgtactgggaaacttcaacgtggagtcccgtccctcatggcaataaagaagtcttcgacaataaatttcacataaatatgcgcgcagtttggggtatgcgcatatcccctgtgcataaatatat

SEQ ID NO: 45173 - DNA, 177 bp, Homo sapiens
tcataagactgtaacagatgaagctcagagcaaccttaacacaacagtttggattttcaaagtttacatttacaagggtggaaaattctcagattctttcttagtttaataaaaattgtattacttggagtatgtcttgatccccaaattacacacaggtgtgtgggagaaaaggaa

SEQ ID NO: 45174 - DNA, 127 bp, Homo sapiens
atgcgctatcctataatgatgcgtgtgagaatgtgtgtgtgttgctcaggcaattatttttgctaaggattgttaattcaaggggcaggctcaatacttggttcaggtataaaaacctggacaagat

SEQ ID NO: 45175 - DNA, 211 bp, Homo sapiens
taagtgggatcgagacatgtaagcagcatcatggaggtttgaagatgccgcattttgaatgggatgaattccaaattctgcttgcttgctttttaatatgataggcctataacactaccacttatggcacaaatatgtgggggtattattatgtgttacacagggccagatatctccttatataattctcactcgagggcgctgtctcaca

SEQ ID NO: 45176 - DNA, 138 bp, Homo sapiens
gtcactgtgaccaacttatgtacacatactttttcttgcttagtttataataatctgttcttaaagaaaatgtcagtctctacattctatgctgactgttaaggaagagcacccacatccgctcctaacttagctttt

SEQ ID NO: 45177 - DNA, 140 bp, Homo sapiens
gttttagttatcagaatagagagttagttgaattctttggatccatttgagtgatgaagcatgggttccaatttgaatagttcataattaattgcattaatagtttgagatacaaatttgattaattaaaaaggttcctt

SEQ ID NO: 45178 - DNA, 215 bp, Homo sapiens
acctcagtcttctctgggtacttctgcccctagtcaccatggcctggggcccagttatggcggattatgggatacccataccagcagtatcgtgactacagcgatgatggggggggtgaatttggacccggcaagggtttcaagtaccaagtgtccccagagggcaaggtgttatgtggccgtgggggggcttcttaagcaaggaggaaggtttt

SEQ ID NO: 45179 - DNA, 233 bp, Homo sapiens
gctgtggttgctgtttgcggtggtctagggaggaagaagttgacacactttgtaacggctgctgtcagccttacacatcccgggactcacacggtgcctttggaggaggaggttgttcacaccagggtatccagcattgaggacctgcttttgtcccagtttgtttctccatttactggatgcatttatggagggcacattacaggtctttgtggggagacacagagagagat

SEQ ID NO: 45180 - DNA, 171 bp, Homo sapiens
tcaaatatatttgactatttagagaatgatttccacctttatgttttaatatcctaggcatctgctgtaataatattttaggaaaatgtttggcatttaagaaataacttgtgttactaatttgtataacccatatctgtgcaatgggatataaaaataacaaaggtgttt

SEQ ID NO: 45181 - DNA, 204 bp, Homo sapiens
aaatggctcgtcaccttcgtgaataccaagacctgctcaatgttaagatggcccttgacattgagattgccacctacaggaagcttctggaaggcgaggagagcaggattttttctgccctttcaaacttttcccccctgaaccctaggggaactaattttgggtcactccccctggggttaaaacccctctaaaaagggaact

SEQ ID NO: 45182 - DNA, 200 bp, Homo sapiens
atcaataggaaagcatatgcagccaaccaagatgcaaatgttttgaaatgatatgaccaaaattttaagtagggaagtcacccaaacacttctgctttcaattaagtgttcttgcccccaaatccctttagggacaaggataaatctttttttactctgggaattttaaaatttcccagagcccctcttttttccccaaa

SEQ ID NO: 45183 - DNA, 222 bp, Homo sapiens
cagctgtacctcttattaacccagctggacttggacctggtgggcccgggcatcttttttctgaaacccatcttcagatgttttgcccacatttacaactttggccagcgttaacttacaacagttgtgggggtgtcctgaaaggcctttttaaggaatagatggtttttcaggccgagacaaatttgggcttttgagggacccttgaccctcttttggttd

SEQ ID NO: 45184 - DNA, 165 bp, Homo sapiens
catccttttggaggtggcaaccaccagcacatcggcaagccctccaccatccgcagagatgcccctcccggccgcaaagtgggtttaattttttgcccgccggattggacgtttccggggaaccaagactgtccaggggaaagagaacctagtcctgaggggcct

SEQ ID NO: 45185 - DNA, 124 bp, Homo sapiens
gatggaaaagctacactaggggcttttaggcatgattgttttaaaatgccatctaagggcacagtgattcccccgtgttagcttgtgttttctataaccctcttccaaaggggccatccaaaaa

SEQ ID NO: 45186 - DNA, 125 bp, Homo sapiens
tcttggggtatatgctggggccgctcggttttctgcttgcagcctkgcccggtagtttttggtgggtgtttggttggttgggataatggggggcctcccccaaacgtgaaatgtttggatgcctg

SEQ ID NO: 45187 - DNA, 251 bp, Homo sapiens
attagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctttgtgggcccaagcctccaagatgggaagaaagacttggatgatgcccccaatgagttaaattgcgttaatttttacctgtaggggaaggggtgtat

SEQ ID NO: 45188 - DNA, 146 bp, Homo sapiens
caagtcctgaaaggcccaaggcccctccccagtctggccttggcctccagcctggagaagggctagcatcagctcattgtcaaggccacccccaccccagaacagaaccgtgtctctgataaaggttttgaagttaataaagtttt

SEQ ID NO: 45189 - DNA, 256 bp, Homo sapiens
tcaacacccctcttttagcaattattagataaagcaggcaaaaaattcatacagatatagttgacctgaacaaccatcaatcaacttgatctaattgacatctataggatattttattcatcaaaaggaggctacacattccgcttcaaggttttgtagggcattcacccatatccaccccattcggggcaataaaacattttcttacagagtttaaaagggtagggggtcatatccgcggatgttcacaggcacc

SEQ ID NO: 45190 - DNA, 244 bp, Homo sapiens
caggcgcacccaagcctcgaaatgcagaacgacgccgggcgagttcgtggacctgtacgtgccgcggaaatgctccgctagcaatcgcatcatcggtgccaaggaccacgcatccatccagatgaaccgtggccgaggttgacagggtcacaggcaggttttattggccagtttaaacatattgttttttgcggggccattcgggggttggtgtgagtcagttgttcccattctccgtttggcc

SEQ ID NO: 45191 - DNA, 253 bp, Homo sapiens
acacacatacaggaagataaaaggtataaaaatatactaagtactttttaaaaaggaaaattcatgttttggattattactgaattgttgctaattactgtaatgtaaggcatatgtccttacataggtttgaaaaatgctttctttaaaaatctaaaaaaagtgtgaataactgatagtcaatgccgtatcattgaagtatcactcaattttttggtaaagggattataaaagatacttaccccggggaact

SEQ ID NO: 45192 - DNA, 222 bp, Homo sapiens
ataatcagcagcgtaactaccctaaaagcatatcactagccaaagagggaaatatctgttcttcttactgtgcctatattaagactaggacaaatgtggtgttgtcttccaactttcattgaaaatgccatatctataccactattttattctgagtcactgatgatgtaatgatatatttcctcactattatatgtagaaaattttcctgggcaagagtat

SEQ ID NO: 45193 - DNA, 250 bp, Homo sapiens
accattcatggaagctgctaaatagcctagtctggggagtcttccataaagttttgcatggagcaaacaaacaggattaaactaggtttggttccttcagccctctaaaagcatagggcttagccttcaggcttccttgggctttctctgtgtgtgtagtgtttgtaaacactatagcatactgtttaagatccagtgttccatgggagaacatttcccacatggcgtgactctttgactatatcagggg

SEQ ID NO: 45194 - DNA, 202 bp, Homo sapiens
tagatattgaggccaagaatattgcaaaatacatgaagcttcatgcacttaaagaagtatttttagaataagaatttgcatacttacctagtgaaacttttctagaatatttttcactctaaggcatgtatgtttctctttgaatatttgcatgttatgtttaataagccccccgcacaatgaaacatgagccaatgattaa

SEQ ID NO: 45195 - DNA, 110 bp, Homo sapiens
aaccaaacggcaaggggagggtttccccccaagacctaataagtcaaaaagccaaagttccagggttaagtaatgtgcccttcaataaaagggttaggttgggtgggtcc

SEQ ID NO: 45196 - DNA, 148 bp, Homo sapiens
ctgttaaaaatgtaaaacttggttgcattatttgtggaggctcaaacttgtgaaggttaataccataatttttccatttgttctgcattttgattctgaaaagaaagctggctttgcccctttcttattaaaaaacctttgttgtaaa

SEQ ID NO: 45197 - DNA, 236 bp, Homo sapiens
aaacccctataaatgtaccaaatgtggaaaatcgttctgtcagcagtcacatgtcattggacatcagagaattcacaagggggaacaaccttatgtatgttctgaatgtggggaagccttctctcaagagccctcacggcccagggcttgggtgaattcttccgggggagaaaccttccatatgtgctgaatgtggaaggccttttctcagaagtcagaccttgttgtacatcaga

SEQ ID NO: 45198 - DNA, 224 bp, Homo sapiens
aaaagaggatctaggatccagttggtgcagcttatggcttgtccctgtgtgtatagttgttaaattattcttttatttttatttttaaggaggttatttctttaggaaattaataggcatgtaggcttaaaagggaacctcaaaagacacaaaggatttgtctcattttaaattaaaaaaatactgtatcagcatcaggtaattaaacatttgttggaatatca

SEQ ID NO: 45199 - DNA, 234 bp, Homo sapiens
aacaagttaccctagggataacagcgctatcctattctagagtccatatcaacaatagggtttacgccctcgatggttggatcaaggacaatcccggttggtgccagccgtttttaaagggttcgtttggttcaacgattaaagtcctacgtgatctgagttcagaccggagtaatccaggtcggtttctatctacttcaaatccctccctgtacgaaaggacaagagaaataa

SEQ ID NO: 45200 - DNA, 228 bp, Homo sapiens
aatggagcaaaacagtctttgaatatcgaacacgcaaggctgtgagactacctattgtaggatattgcaccctttggacattgggtgggcccggatcaaggatttgggggttggacgtttggccccttttgctttttaaaaaaccaaacttttttctgaaatccccaacaaaaaaaatttgattgccatatgtgtccccctggtactaattttagtcaaccagtgcaa

SEQ ID NO: 45201 - DNA, 231 bp, Homo sapiens
aaaaacttattcgtctaatggaagagatcatgagttagaaggagaataaaaccattgtttttgtgggaaccaaaaggaagttgtgattgagcttaccaaaaaaattgggggggaggttgggtggcctcccatgggttttccatggtgccaagagtcaacaaggggcttgactgggttctaaatgaattcaaacatggaaaagctcctattctgattgctacagatgtggcc

SEQ ID NO: 45202 - DNA, 218 bp, Homo sapiens
aatttaacaatgaaaatttatataacagtgggaaaacatttaagaattggtcacccggaaaaggtttataaaattgttttgcttataaataattggctatttggccggcattcctcttatgttgtacaaagatttaaaaaaaacagcagcccaggcgctgtggctcaagcctgttatcacagccctttgggaggcacggcaggcagatcatgaggtca

SEQ ID NO: 45203 - DNA, 222 bp, Homo sapiens
tacatgtctcccatcagaaagattcattggcatgccacaggggattctcctccttcatccgataaaggtcaacaataaaaaccaaattatggggctgcttttgtcacactagcatagagaatgtgttgaaatttaactttgtaagctggtatgtgggttgttgaatctttttttccccccccagacaccgctaatagattatcatattaagagcgggagcag

SEQ ID NO: 45204 - DNA, 234 bp, Homo sapiens
ctttattaaggtgattgtgtctttgaatgacaaatgtactgctgcttccgaccggcaagacggacaatgtatgtttcaagggggagcagtgttatttcctaaaatttctcaaaggggcggtggtaactattggttctgcccctcaattgttgccagcctctttgaaggagggggagaattgttgtgtttctgtgtggggatgtttctgatatgctgcccacagttgcacaacac

SEQ ID NO: 45205 - DNA, 222 bp, Homo sapiens
cttctgctgagggggcaggcggagttgaggaaaccgcagataagtttttttctctttgaaagatagagattaatacaactacttaaaaaatataggcaataggttactaaggatattgccttagcgttaagttttaacgtaattttaataggcttaaggcattttaagcggaaatatgggggcattcagaagcggagccatgaggcaaggacaagatacaca

SEQ ID NO: 45206 - DNA, 153 bp, Homo sapiens
cgaggctaggggcatctaacctcagaactgaataagctttgaaaaaaatctgtaaacatcatcctccatcagaggtggcaatggggataaaatagcaggtcaacacgtccaaaaaaaaaaaaaaaaaaccgaaaaaaaaaacttggggcctct

SEQ ID NO: 45207 - DNA, 244 bp, Homo sapiens
agaggatgctgagaaatgtgtaggggcacttttttggttgtcatatttactaggggcttctgttggcatttaagcctaaagacactcacccctgcagtgcatgggacagcctgcgcacaatgcagcattagccctcccaaaatgtagattattttatttcaagggatagggcagattaccattagaggcaaaattaaaagtacatgctagggcaaactgacagagtactagataggtgagactm

SEQ ID NO: 45208 - DNA, 198 bp, Homo sapiens
agataagtagtacatggtggataacttctacttttaggaggactactctcttctgacagtcctagactggtcttctacactaagacaccgtgaaggagtatgtgctccgattattcctaggctttgtgctctgccaaacccttctttaggactctcacacatacgcactgtaagaaatatgatgctgtgaggatatag

SEQ ID NO: 45209 - DNA, 182 bp, Homo sapiens
caaagtgttgggattataggtgtgagccactgcacccagcctacttcactcttctgaattattctgatttattttcaacaacttttgtgaacctagcccgtgatacaaagcagatagtccctgaaccacagtcgtgcctccttgaaacaagccattctacctggtgctaatgttttgatatc

SEQ ID NO: 45210 - DNA, 225 bp, Homo sapiens
tggtgtgaatgaagacttggctgattcagatgccagggccttgtatgaagcaggagaaaggagaaagggggacagacgtaaacgtgttcaataccgtccttaccaccagaagctatccacaacttcgcagagtgtttcagaaatacaccacgtacagtaggcatgacatgaccaaggtcttggaccaggagttgcaatgcgtcacattggaattccctcacagtt

SEQ ID NO: 45211 - DNA, 229 bp, Homo sapiens
taacaaattttaccctaacagttttaccacctagtaacagtcatttctgagaatatgttggatagagagtcactctttggcaaaagtgttaggaatttgcttttgtgccatctattccgtttatggcatctatcttgaaagtcatcttgtattggagattgagagatgctgtacattcagagacttcacactgctatctctaacataccccttgtagagatatagagtk

SEQ ID NO: 45212 - DNA, 138 bp, Homo sapiens
agagggccattactggtgcatctcttgctgatataatggccaagaggaatcagaacctgaaagttagaaaggctcaacgagaacaagctatcaaggctgctaaggtagcaaaaaggctaagcaagcatctgaaaaggc

SEQ ID NO: 45213 - DNA, 198 bp, Homo sapiens
atcttccttgtaattgtctctgacctttttatctgagaccggaattcaggataggagtctagatatttacctgatactaatcagggaatatatgatatccgtatttaaaatgtagttagttatatttaatgacctcattcctaagatccattttgttaaatgtagcttcaaattctgttattgctgtttgaataatat

SEQ ID NO: 45214 - DNA, 196 bp, Homo sapiens
aatgaaggccatcttgatggtctcaacactaatttttatgatgcaaatttatacactgatttttgtaaaggacaaagttttaaaagcgtatttgacttgatgttttctatcagcataaataaaatggtcatgaatagtcattaaaaacagttgccagtgataatctgcatttgagggcaaaggacccatcaaattg

SEQ ID NO: 45215 - DNA, 146 bp, Homo sapiens
gagaacaaggaatgcaaaaccagcatcacacaagcagtacggataaacgcgaggtcatttgcaggcagtggcaagcgatgccaagaaccctggagcagggccatttccatcgttaggacgggccccccacggagaagtaaaatttt

SEQ ID NO: 45216 - DNA, 305 bp, Homo sapiens
agactggtgtcatagggtttgtattgttttgagagtctcattttaaaatcatttgttgctgcacagacataacgtagtagatgtaataatacttactaaagcgttaaatcaaggagttgattactttttgaccttgtttgcatttgagactgtattttctaaaccaattatttgactataatattcattgatgcgtcaaatatgatttggaatggggggattcagttcttagtagtaccgaaacataatttgactgtttaaaggaattgcccgggtcggggtcatatatttgtctggagcagctc

SEQ ID NO: 45217 - DNA, 178 bp, Homo sapiens
tgatatttataaagagctcactggcgggagctggttgtgtgtttatggctgaacatctatctgataacaatgtgctgctcttccagtagacttggatagtcatgtccgtgcttacctaacattgctgacaaagacttgtattctgccgtcatctgactctcaataaatggatcagtcc

SEQ ID NO: 45218 - DNA, 290 bp, Homo sapiens
actgtgaaatatgttgattacaaacccattcattacatagtataaggcattcacagtatattgactatatagtgtctaatgatcttgggcagatactgtcaaacttacaatatctatatagatgtaggtctttttaaatttacctagtcattcttctatcatgtatattgatgctgaaagaggacctggtcagctcctcttggccaccaaattcttggyctttaattattagggggccatctgcttgtttccaaagtgcgtgtgaccgtgcgcaccgtacactcgtgctc

SEQ ID NO: 45219 - DNA, 295 bp, Homo sapiens
tagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggggatataaacattcccgtgtatacagaggaggcaaatcttttaatccatatagcgcgattcacaca

SEQ ID NO: 45220 - DNA, 212 bp, Homo sapiens
gaaacccttccaggccctgtgcgcctttctcatcagcttcttccgagggtgacaggtgaaagacccctacagatctgacctctccctgacagacaaccatctctttttatattatgtcgctttcaatccaacgttctcacactggaggaggagagtttctaatcagatgcaacggcccaaattcttgatctgcagcttctctgaagattggr

SEQ ID NO: 45221 - DNA, 295 bp, Homo sapiens
agggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcctataacctgaacgattatgacgcggcataagcggtagtcacacacatgttttgcaacacaggttttattagacatgagggttctcag

SEQ ID NO: 45222 - DNA, 199 bp, Homo sapiens
acacaatgtcgttttgtaaaggtaggttgtaaatattttatttgtaagtcaaaatcactcatgtgtaatgttgtaaagtgatgacctgctgtcttgttactgctacagtaaatgttataagctatggctgaaacttcaaaatgtacatgtcacatgttatgcattcctataaatatacgatactaaaggtacccaaaaa

SEQ ID NO: 45223 - DNA, 263 bp, Homo sapiens
aaaatatctgtaatgcctttaaaaacacagttaaaatataacagtgctgtagaaccggcgaagccctgagatcttcaacagctgtaactctgtccaagattcagggcaataaaatttaattatttattaaatggacaatttcattgtgcagggccccagtctcttgctcaacaagtcctcaggatggtagcacagacacctatataaaatcatattgccatatttttctcactgtcattaaaaaatttttttttgctgaaggg

SEQ ID NO: 45224 - DNA, 125 bp, Homo sapiens
tcagggtcatagcactttcagacttgctagtagatttgactttaggtgtgttgacgcagtcatctttttgcattgttttctcagagcttgaggttgctgggcacctcattgatgtttcatgatat

SEQ ID NO: 45225 - DNA, 174 bp, Homo sapiens
gataaaccaactttcccaaaaagggagatgttgttcactgctggtatacaggaacactacaagatgggactgtttttgatactaatattcagacaagtgcaaagaaggaggacaatgccaagcactctcaggttttcaagggcgggggtaggccaaagttatccagagggtcgg

SEQ ID NO: 45226 - DNA, 175 bp, Homo sapiens
ttaattgatttacagccttgttgccgctggccagaccaccaggtgggcccattactcgagatgatcatcacaatccagatgatgctaacctatatcctctatccttcgcgtgctttgtcttgggaagcaaatatagggcccatggcaaggttctatttgcaattaagggtccaag

SEQ ID NO: 45227 - DNA, 113 bp, Homo sapiens
gggagagagagagcaagagggagagtgtgtgagagagagtcagttcaagccaaaatggcctacagagtctctgctggtttctgaatatttaaaatacaaaaaaaccagttgga

SEQ ID NO: 45228 - DNA, 123 bp, Homo sapiens
ggtgcaatttctaaggtacaattgctctattgagtcaccacgaaaagcttggagcttcatgcatcctgggagactcacacatatgcatgcacggacttccagcttaaaaatggtaccaagatm

SEQ ID NO: 45229 - DNA, 135 bp, Homo sapiens
ttttttttccatgactgcattttactgtacagagttgctgctgctgcgatatttgtgatataggaattgagaggatacacacgtttgtttgcttcgtggcctatgtgtatgtgcacacgttaggtattgaggact

SEQ ID NO: 45230 - DNA, 110 bp, Homo sapiens
ggaggtacagattgatacattggttacgctgccttgagagatactagagcagccgcttttggcaagctttaacatatataattcatataagatttgtaaacctctctcag

SEQ ID NO: 45231 - DNA, 209 bp, Homo sapiens
acagatctgtgctgagagaacacgtttgtttgagagtccatggatggtggtttcagtttagctacggcatcatgacttcctgaggatgtcctttgatgtcaagctggcattcttcggacttttctccagccgagcttgcgagaacatcacatatcactgcaaaagtcgcattgcatacatgggtcaggccagtggaaatgtaaggcggg

SEQ ID NO: 45232 - DNA, 142 bp, Homo sapiens
ttacttgtattgacataattagatagtcatattaacatattgacttcagagaattttaggcaggcccagtatcacattctcttgagcactatttggacattatcatgcatcatcacatggacactcttgagcgtatttatcg

SEQ ID NO: 45233 - DNA, 216 bp, Homo sapiens
  misc_feature 53, 168: n = A,T,C or G
ggaaatgttttgtaaacatttattttttttaaagaaaagatgaaaggtaggcntatttcatcacaagaacacacacatatacacgaatagacatcaaactcaatgcttttttgtaaatttagtggtttttttatttctactgtcaaatgatgtgcaaaaccttttacnagttgcatggaaatcagccaagctttataatccttaaatcttaatgtt

SEQ ID NO: 45234 - DNA, 173 bp, Homo sapiens
ggagtaatcaggtcggtttctatctacttcaaattgctccctgtacgaaaggacaagagaaataaggcctacttcacaaagcgccttcccccgtaaatgatatcatctcaacttagtattatacccacacccacccaagaacagggtttaataaaaaaaaaaaaaaaaaaaaa

SEQ ID NO: 45235 - DNA, 236 bp, Homo sapiens
tgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagaacagcagctttctagtgtggaatcagagcttcaaagagaaaaaacgggactgcaatcagaacgttcagccg

SEQ ID NO: 45236 - DNA, 220 bp, Homo sapiens
attgaggcagcagcgcaggggcttctgctgagggggcaggcggagttgaggccaccgcagataagtttttttctctttgacagatagagattcatacaactacttactgaatatagtcaataggttactgagatattgcttagcgttgagttttgcacgtcattttaatagcttcagatttgcagagacaatatgaagacttagcagagtagcatgaggc

SEQ ID NO: 45237 - DNA, 131 bp, Homo sapiens
ttcggggacgttgtctgcagggactcagaatggtccagcgtttgacataccgacgtaggctttcctacaatacaggattgtaacaaaactaggcagtgaccgcaacgcactggtgaataagagttgtttac

SEQ ID NO: 45238 - DNA, 206 bp, Homo sapiens
cccgggtagctgggactacaggtaccttcaccacacccggctggtttttcatatttttagtagagatggggtttcaccattttggccagaatgctatcgatatcctgaccacgtgatctgcccacctcggcatcccaaagtgctgggattacaggggtgatcacgccacctggcccagccgaaaaacttttttataaaacagttta

SEQ ID NO: 45239 - DNA, 194 bp, Homo sapiens
ttacagaaatatttaaaaatgacacaaagaatatcatgagatttctggaatatatattcagcagaatgaaggcttgcagccaaagcaggacttctttgccaaccacgatagacaagtccctatggatgaacttttgatgaaagattgccaacagctactttattggagatgaggactcaatctgatagacttca

SEQ ID NO: 45240 - DNA, 159 bp, Homo sapiens
tctaattaaaagaagaattgaaaacttctcttgcattcttctctctctttactgaagctgaatcctacatttcttctgcacatctacttgcttaaattgtgggcaaaagagaaaaaggaggatttgatcagagcattgtgcaatacagagttcattaac

SEQ ID NO: 45241 - DNA, 427 bp, Homo sapiens
ctgcctgtgtgtgtgcaagtgtgcaggttcctttgtatgtatgtgtacgtgtgggaacctgtgtttgtcacatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactccgggcatttagtggctttgtgaaggaaagaaaccattaaatgacctgac

SEQ ID NO: 45242 - DNA, 310 bp, Homo sapiens
gcttcatgaagcttttattcatggcagaaggtgaagggggagcagctttgtcagatgacaagagagggaataagagagggggcaggtgccagattctttaaacaattagatctcacaataactcatgaccacagggagggcaccaagccatttatgagggctctgaccccatgacccaagcatctcccactaggcccaccatcaacattgggaatcaaatctcaacatgagatttggagggtataaatacccaaaccatatcaagcaaagcacaataaaacaagtatgcctgtatttatacacatattac

SEQ ID NO: 45243 - DNA, 572 bp, Homo sapiens
tttagaaattttgcatctatgtagaaatactgtaactttttttctgcttgaatctcttaatgtggtgaagaactggtaccaattctactgaaactattcaaaaaatttgaggaggaaggactcctctccaactcattctataaagccagcatcaccctgataccaaaatctggcaaagacataatgataaaagaaagctacaggccaatatctctgatgaatgtatgtgcaaaaatcctcaacaaaatactagcaaactgaatccgaagcacattaaaaagttaattcatcatgatcaagttggtttcattcctgggatgcaaggttggttcaacatacacaaatcaataaatgtgattcaccacataaacagaattaaaaacaaaaaccatatgatcatctcaatagacacagaaaaagctttttataaaattcaacatcccatcatggtaaaagccctctaaaaaatggtcaccaaaggaacatacctcaacataagagccatctatgataaactagctaacatcatactgaaggggcaaaaattgggagcattccctgggagaattggg

SEQ ID NO: 45244 - DNA, 400 bp, Homo sapiens
ttgcctttgccttttattagaggggtgagtttttagttatcagaatagagagttagttggggctttggatccatttgagtgaggaagcatgggttccaatttgaatagtgcataattaattgcatgatgattgggagatacaatttagtatcataaataagttacttttgtaacttgtcaacaattacttcctgcattggaaaagtgaatgtgtcgctttagatttggctgagaaaatagaatttaatggatttggggggtaagactcaagttaagaattatggaaagaaaatggttcatgaccagaaatatcataagggctggggcattgataagtccctaggaagggtatttggaaggcggaaaggataagggccttattataataggctctccgcat

SEQ ID NO: 45245 - DNA, 157 bp, Homo sapiens
aatctgagacaaggaaagagcattctttaaagaggaaaactgggatcaaaatcttttagtactattttctggtattgaggcgactttttataaaacacaattttttgtatgtttcttacattaaaaaggttgtaagttgaaaaaaaaaaaaaaaaaa

SEQ ID NO: 45246 - DNA, 436 bp, Homo sapiens
gcccagctcgaacattgtccctaatgcaaagggggaagaagagcccgaaggggaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaatgtgggattatgggcacaggaaaaagtgggttttttaggtgaattttttttaacattcctcatgaatgtaaatttgaactatttaactgactattcttgaggaaaatctggcatggggataaaaataaaaaagatccc

SEQ ID NO: 45247 - DNA, 300 bp, Homo sapiens
tgcaaaaaagaggacgacatgagaagggtggatttcctaacaaattatgtggaggggagggacggcggggattttattcatcccgtctgagttcttcatacagtattaccattaggttttaagaacaaagatgggggaggagggagtagaaagctgagagtacgtagaacagctacaagacgttagtgggtattcagattttgagctgtgtaaatatcaaacatcggcttccagccttaagagttatttgagcagagagttaaggaggaatgggagattttgggaataaaatgttttgcc

SEQ ID NO: 45248 - DNA, 351 bp, Homo sapiens
ggtcttcagacagaatcttttccaggaggctgaggaattcctctacagattcttgccacagaaaatcatatacttgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatgg

SEQ ID NO: 45249 - DNA, 375 bp, Homo sapiens
agacgtacgaagcgcttttggcctcagagccgatgagcaagcagagtccacgaatcctcggcccaggtttaaataaggcaggaaagccccttccctgctcacacacaacgaaaacatggtggccaaagaggatgaggtgaagtccacaatcaagttccaaatgaagaaggtgttgtgtctggctgtagctgttggcacgtgaagatgacagacgatgagcttgtgtataacattcacctggctgcaacttcttggtgcattgctcaagaaaaactggcagaatgccgggcttatatatcaagagcaccatgggcaagccccagcgctatattaaggcacatttgaataaatctattaccagaaaaaaaaaaaaaa

SEQ ID NO: 45250 - DNA, 136 bp, Homo sapiens
tgttagtccaaagaggaacagctctttggacactaggaaaaaaccttgtagagagagtaaaaaatttaacacccatagtaggcctaaaagcagccaccaattaagaaagcgttcaagctcaacacccactacctaa

SEQ ID NO: 45251 - DNA, 338 bp, Homo sapiens
gaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagacctaattaaatagctgactaca

SEQ ID NO: 45252 - DNA, 230 bp, Homo sapiens
aaggataaattgttacaggaaagtaaacagttctaggtctaagggcttgaagactattacaaagtgatagacgtggggctttaggcattatcaatcggacaaattcctaggaactgcggatattgctcgccacagtatcttatcagttaattgcactcttagatgtgctaagagtcagcttgcacaagttaagtccttgaggaaggggctgccagtgcaaagagctagga

SEQ ID NO: 45253 - DNA, 365 bp, Homo sapiens
gaacgcgaacaaaaccagttcatactggtcggaggccgcctgcagaacgagggtgagcctgcaaatgtaaaaacgagtgatcagaaagtgcactaaaggcgtctgagagcaaaaagagagtgacctctattggaaacctgtgcacaaattcaataattcagagatgctacagacttctgcaagcttcctgattatgtcactgtaatattaatgacctaagcccgaatgtatttccttacagccattaatttgacatccatcttttacctggggaggattacaattgcaataaggcattaatgggttcttcacacagcttcttaaaccaaggttctctgcagctctatcgggctgcttacaggggg

SEQ ID NO: 45254 - DNA, 531 bp, Homo sapiens
tatagcgggcgttataaacataccacttcccggtacaacggatttcaaggttaggggtgcaacccagaacgaacgcgttaagtgcgcgttatcttcctaggatagagtcggtgacgggaatcttttaccccggcactcgggtccaccctcgcggcaccagaggtattctccggcgagtcgttaaccatcgcaatcgccgaccgagtttaaggaccactccccacctttctcattagttaaggagaacgctactttaccccatagacggagaaatcgctactcaactaccaggcgcgcgccgtcgagtccctcttcctctctttatgcatttagagcgctttcgtaagagttttccctagattcttctaagcgtagcgcgtctactccaatgttttcgttaatccagcccgaactaacgccgcggaggagtcgatccgtctactcctatcccgtcggctcggatttactacaggagctaagaaaacaaaaagtaccagccctaaaggaaagtcaaaggacgcccgtaaaaaa

SEQ ID NO: 45255 - DNA, 362 bp, Homo sapiens
ggttgggacccgaaagaacctacacctatcccgtctccctacccgataacaacaaaacccaatggcccaccattcggaaagagcgtaagaaaacatcaaataatcccactaaatcgacctatatcgaggggaggccaccccgcaataaacaacggattataagcctaccccgcacctcctcgcagcagaggtcatcgacacgaacccaagaaaaaattccagaactccaatcccctatactcgtagacgtagcgcgttacctcgaaccccctaactcaagggacgcggacatacagaacgcccaaaaagacaataaccagaacgaaaaaccaaaaccacgcacgtccccaaaaaaaaaaaaa

SEQ ID NO: 45256 - DNA, 311 bp, Homo sapiens
gtcttgaagctctgattggagctttggatccatttccatcgggccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagaagatgtggaagactgcaaggatgctgcttcagagtgtgaggtcaaatgcatgccaacattccag

SEQ ID NO: 45257 - DNA, 620 bp, Homo sapiens
aacgcccggaaatagcgcaacccgataaagaaaaacgacatcctctcccccccgtcgccttattaaacataacctaaacgtcccccgccccacccccccattaaccttaaccctaaaacgctctaacggcgtcacaacaaacaaatcctaatatctcccacgacaataatatcgcgccacacctcccgaacttcagtttactcgtagagtaacgatcgcgtctattagcaaaagacaattccctccctcgaaacagctaaacatgaaaccagaaaagtttctttcaccccaatcattctaatcggctagaaatatagaccgcacctcacgagctttagaagacgaaaaaaaccccacatgccgacaaaatccacaaaccctaccgaccaactcttcggaagaccggcccaaaaagaaaagcgcaacgtaagaacccaaagaaacacccccaaagttataaccaccccaacaccggacactaatcgtccgcaaaggcgtcttctcccccctccgctaccgtcggctaagaccatcaacacccgggaaggtcccaaagatgtacgccacggcgtcaacgcatccctatcccaaattcttagaatagaaccgcgatccgtacc

SEQ ID NO: 45258 - DNA, 331 bp, Homo sapiens
tacacgtaaatcatcattatcgtcatttatttatttctaaagttaaagcgcgacacttaacgaatatcgcagacatagtcgcaagaaaaggctccctttacacaaaagttaacttacaaaaccggaagaaacgatcgccacgctagaggtatagacagctatacaaggacgtaagaaacacgaaaaaggaaatacaatactctaaagaagtataacaacctcttaagtaatagacttaacgaaaagaaaactcacgaaacattcgaaaaaaacctagaacaacgccaccaaagaaatctagggagacataagagaatatatacaacgaaca

SEQ ID NO: 45259 - DNA, 325 bp, Homo sapiens
cccggcgcggatgccggtttcgcccgtcccccatctattaaatctcactcgaaacttcaataaaagggacccaatcttacacgcgccttctccgcctcaactccgctaattagcgtaagcgattgataaaaccttagccacccacccttaaaacgcccggaaatagcacaacccgataaagaaaaacgacatcctctcccccccgtcgccttattaaacataacctaaacgtcccccgccccacccccccattaaccttaaccctaaaacgctctaacggcgtcacaacaaacaaatcctaatatttaaaaaaaaaaaaaaaaaa

SEQ ID NO: 45260 - DNA, 530 bp, Homo sapiens
aatctcgatcgcaaacatacggcactctccctcttgccgcggttttcgtccagcgctttccattcggtccagtgcctcgccctattagcccttaagcccaccgtttctaaaactcccagaacagccaaaccggtccgcccaaggcctccgtcgttttataatatattccgtttacgtataaggaacgaaccccccttcattaccacggtcccgcgtccgcctccttctccattcgcaacagttctattcctttcagcctcccgtacctgcttccagaacatcgcaccgccatagtcgaaagatagcaaagattacccagcttctattcctcgccccagagccgagtaaatcgaagtttatagaggcggaatccaaccattcaagagttataacaagttatcggcactcgggggatcagaatataaacttaatgtcccctttattctcccggacgccccttttaaccacttcttcctatctttcgctaacaagccattgacggcgctttgccgcgcgggcccatctcgcgt

SEQ ID NO: 45261 - DNA, 154 bp, Homo sapiens
gaggggaaaccccgtaaagtggttgggtgcagacgtgtagtagttaaggactatggcaaggagtctcaggccaaggatgttattgaagagtatttcaaatgcaagaaatgaagaaataaatctttggctcacattcgaaaaaaaaaaaaaaaaa

SEQ ID NO: 45262 - DNA, 520 bp, Homo sapiens
acttctctttttttgctgatccaccatttacaattcaaatgctttttgttttatttttttgccaattccaatttcaaaatggctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggcagaaacacagattggattctatgagtcccagaagatgaaaaaaattttatacgttgataaaacttataaattcattgattaatctcctggaagattggttaaaaagaaaagtgtaatgcaagaatttaaagacgcatgtatgggctaatggaccttcactttaaactctagatcagaatggtggcttgcttcagacataaaggccaaaatctggactggctccctcagaaagatcatgggctgccccaggggg

SEQ ID NO: 45263 - DNA, 274 bp, Homo sapiens
tggttggggacgccaaatctcgcaaggaagcctttaatcacaaatccacaattttagtcgcggctctcgagagatcgaagacctgaggtctttcggttagggtagtttcctaggagtcttccagcaaaggatccactaaatcggccctaaagtatagagtctaagcaacccatattagaaacattaagggcggagacgtcttaagtcgtcggcgaagacgtacgaacaggcttaattaagtcgcatacccggaaaaaaaaaaaaaaaaaaaaaa

SEQ ID NO: 45264 - DNA, 610 bp, Homo sapiens
gggaacctggtacatggttgggacctccgcccataaaaacctccccaatcgcccgtaaaaggccatatcgaacgcatacattcaaggcgtctcaccctctcggcaacacagtacggcatcaatcccaccgcgccctcccacgcgaaactatcagccctcttctctacttttaaccgcgcgccttaacacgatatcccttttataagagttcagtgagggaggatcgcaatctccccactcgaaactttctcgaacctgaaggaaagacagtttcggctccgtccagtccggatccggagtaacatatacaaccgaaaacagaggcggcggcttcgtctaccatacaaataagaagctcgtaactctagccacgttaggcccttactcccagtccccccttttatcccggtcgctatagatcgcgaaggagctcggtagttcctaaacaaaaggcctaagtaactccttcgaaacgatcgaaatccgaagacactaagccatccccaacgtttgctccatctttcttcgtcatactaagcgatcgaatactcaaaactcccctcgagcaaaagtcgtagaaaaccgaacaccacctcctccggagaacgac

SEQ ID NO: 45265 - DNA, 550 bp, Homo sapiens
ttggttgggtcttcaaagcgtcgggaccataggtccgagttatcgtcttcggttaatacttagcaccccactccgatcgcttcaattccattccagacgtcaatagaagggcttcgtctaaacaatatcgggcgtcacaccgacgggcaaacgcgcatacttcaccttccttctcccactctataacccccgctcttatcaagtaagaagcaaatcaatatcctgctatctcaaagaaacaatccacgcaaaatctccagcaatttcgcccgctcctaaacgagcaaacagattaaagcggggggataacccctcaagcctcgcagagggaaaaatactcgagctaatacccctaaacgtagagggcaccggcatacgatgatacggaaaagggtatccccaaatatagtccatctccttctaagcatagagagcacacagcgaactaaaatcaatcatagttacctcccccaaagtttaagggacggagtaaaggcgcaaggacgccattcgcccgccccaactagagagtaaaaagaagctataacag

SEQ ID NO: 45266 - DNA, 201 bp, Homo sapiens
aatacatagaagtggggaaggaatagataggaaagtagaaagacaagaaagagagaacaggggagaaaaagaagaaagagagagaaagaaagaagaaagaaagaaagaaaaagaaagaaagaaagaaagaaagaaagaaagaaaagaaagaaagaaagaaaagaaagaaagaaagaaagaaggaaagaaagaaagaaagaa

SEQ ID NO: 45267 - DNA, 500 bp, Homo sapiens
gaaaaaaaaaagcacttaacagtagcttgtctttgatttagggatgaaagcgaaaacgagttcattactaggcaaagactttaaatcagctatggtaaatatattcaaaaagctgaaactaagtctaaagagttaagttatgagagcaatacctcaccaaatagtgaataccaataaagagatataaattataaaatgggaccaaatagaaattttggaattgaaaagtagaataactaaaagaaaaaattactagaggggcttaacagaagatttgaacagaccaaagaaagaatgagaggcttgaaacaggtaaattgagagtatccagtcagaggccaagaaagaaaaagatgaggaaaaattaacagagcctaggagccgggggcattaagcccatcaatacacccataaagagcgctcagagaagagagagaaaggggtagacccatgatttgaagaaataatggtgaaactttgcaaatttgataaaaaatttc

SEQ ID NO: 45268 - DNA, 540 bp, Homo sapiens
ggttgggggcggatatgacctcagcgtcgagaagaaatatgcccggcccggagagcttacggacggcggcccctagcccagtcatggtaacttcgaatccttcgaagacgcttccgacgcgtagtcggtaccttcctgatcctctcttagttgagtcctttagaatactatacactatcgtaaaaacagtaccgtacatacggactaggttagcggaaacgcaaagaaggtttcgaagtcgacggggctaaacgaaggcgaacctaaggtcgaaggaaacagtaaacctattcatatagcctcggaggacggccgtatgaaatatatcggggaacggagtaaaatagctcccgaacactgaatatgtaaggtcgcgagatcattcaccgcagacaccgtatttcacgataccggcggcttcgactaagaacccggcgcgggatgccggtttcgcccgtcccccacaaattaaatctcactcgaaactttaataaaaaaaaacccaatcttacacgcgccttctccgcctcaactccgcta

SEQ ID NO: 45269 - DNA, 560 bp, Homo sapiens
ttgggggaacaaataaacctagccctctttatcccaactctataatatttcctcgatcttagacgcgcgcggaggggggccttttatgtaccaagtaaacaagtaaccccgtagtagatattagtcgggcgcttctcaacctaacctatcctccatatcattcggagacagtactagacattacaggccgaaggtctagcgttataagacggtctttatcctagacgataactagaagttttagacggcgattaagggcttcaattaatcagtcacaagccagggcctttacaattttcctccgagtcttaccagcccgtcagagagttctatagaatctggaaatatcacatagctacgtcgcatacaacgataccctaacgctagttcgtacagataacggcgactttacaagaccacaacatcgcacccccatcgcattcccctcacgcccaggcacgcccagacagataaacagctaacttccgaataatccgggcccgaatcgcgcgggcttatccacatacggacccccccctaacaaacgcaccggaaaacca

SEQ ID NO: 45270 - DNA, 420 bp, Homo sapiens
cagacacagacttcgctcgaacctaggtgcccctgggccggaggtgctccgcaagcatgtggggacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctggttaactttgtaagatgcaaagagggtggatcaagtttaaatgactgtgctgccctttcacatcaaagaactactgacaacgaaggcgcgctgcctttcccatctgtctatctatctggctggcagggaaggaaagaacttgcatgttggtgaagga

SEQ ID NO: 45271 - DNA, 377 bp, Homo sapiens
gggaacctggtaccttggttgggacagctaacagaaaataattgaaattaaacaacctaagtatcgtccaccataatccccatcgggctctcaccccatttcttcataagttctagagcatcctgagctctttcctattacccttgatggtactcatggtctaataccccccgcagttataggtccttatggatcctatgctaccaccggtctaatcccttctatcactcgtcctacttgttaatcaacaccctatcccatacttaaatactatcccggtcctgaagttgttgttcgacatcggtaccccgcagacgcggcccgatcaccctcgcacgctcttactcaccgacgagggctccaaaaaaaaaaaaaaa

SEQ ID NO: 45272 - DNA, 100 bp, Homo sapiens
tgggaaagactgcaatatgctggatggagtctagtttagactggcaagaggggggcgggatgacggggtttttttattgttggccaaaaacaaaaggcgg

SEQ ID NO: 45273 - DNA, 399 bp, Homo sapiens
gggcataggattttttatggaaggataaaatttgagagttaagctaattcctgttctggaatagtctctataatgtgctggatgggaagttatcaggtctgatattttctgtgtgcctcttagatcaactccttcctctttcagataattaattcttcattttgaaaacttaattctccttctagtttgtataccgttattttccataaattttcatagcaatttgatgataacttcctataccatacatttaaggctataaaaaaaattacagtatttaaaacagtttaattctgtaatgataacaggcagaccagtgactagaatacattcaagcatctggaaatttagaatataacaaaggagatatttcaaataagtaggaaaacaaattatttg

SEQ ID NO: 45274 - DNA, 424 bp, Homo sapiens
acgattgaacaggagaagcaagcaggcgaatcgtaatgaggcgtgcgccgccaatatgcactgtacattccacaagcattgcctgctaagttaacgtcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacagttttttta

SEQ ID NO: 45275 - DNA, 532 bp, Homo sapiens
cctattattccaagcaaaataagagataaacccttcaagttaaattgaaaattttcctgaaaccatacatttcaacgtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgcgacattgactaaaaggtcatgatgaatggaatatgtaagacttggctcatagacacctaatcagatggttagaggtgttggcagtttaggacctgctgtcataaatgtgtgaacaaccttttgtaacctaacctattgacctgcatgttttttccttaccccaattcattacatggaggctcaatcttggagtttgctttaac

SEQ ID NO: 45276 - DNA, 301 bp, Homo sapiens
ggtgcttccggtgcagaggtcagggacaagatggtgctaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggcttgccagagaattggcagaagatgacagcatattaaagtgagtgaccctgcgacccactctttggaccagcagcggatgaataaagcttcctgtgttgtgtg

SEQ ID NO: 45277 - DNA, 467 bp, Homo sapiens
gagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaaca

SEQ ID NO: 45278 - DNA, 322 bp, Homo sapiens
gatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatg

SEQ ID NO: 45279 - DNA, 668 bp, Homo sapiens
  misc_feature 642: n = A,T,C or G
ggagtcgacgtgtgcagaagtcctggtaatctggtccttgttcccgtctggataccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaagggtaatcgaaaccatccttaccctaattaatgtagtttaccttgattttatctgatattaacaataccatatagcttgcttttaataacattccggaaatcccttggccaaaattctacttaaaacctggtgctaataaagggtttaaatgtacctctggtaacngcatcccaatggtaatggaatttgaa

SEQ ID NO: 45280 - DNA, 160 bp, Homo sapiens
gggaatccccttagaaatgtgacataaaacttagaagctataaatggaaaaaaaaaaaaaaaggccgggggttttacctatataaaggtaaaaaaaaaaaggaatttgtcctggcccaaaaaaaaaaaaaaaaaaaaaaaaaaatgttgggggggccccc

SEQ ID NO: 45281 - DNA, 570 bp, Homo sapiens
ggagtttggggcgcggacttcaactaccttgcgtgtagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgagtcattctcatttacttaattgaggagtaggagactaaaagaatgttcactctttgaatttcctggataagagttctggagatggcagctattggacacatggattttctcagatttgcacttactgctagctcctgctttttatgcaggagaaaaagccaagagttcactgtgtgtcagaacacttt

SEQ ID NO: 45282 - DNA, 510 bp, Homo sapiens
aacaccctggagcttgaagtagggtggatgacacccccgagtcttccgaagaacgaaaatcaggggagtcatatgtacatcatgtttgtgtaggcataatctcgtgccccttgaactcccctgtgcagctggctggactgaaattactagggcacttgagtataaaatttgaagatcactatgtgattaccagttatattccagatttcctcaccttgttaaacaaaggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattggaaatatttgagaatataaattttcagttcaaaacaaaggcaaagctatttaccaagggaaaagtcactaaatctgagcctaattcaaatattccagggagcaaaacaatttgggcaagaaaaccc

SEQ ID NO: 45283 - DNA, 347 bp, Homo sapiens
tactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacctaaaaaaaaaaaaaaaaaa

SEQ ID NO: 45284 - DNA, 107 bp, Homo sapiens
atttttttgtctttaaatagatacaaatgtctatcaactttaatcaagttgtaacttatattgaagacaatttgatacataataaaaaattatgacaatgtcaaaaa

SEQ ID NO: 45285 - DNA, 526 bp, Homo sapiens
gttccagtggtcttttagattaaaccagatactcctgtacttgagtaattttcctccctgcacacgggtaataataagcccattgcccatcccctgactctcctgtgactctcctgaatccacagctttgattggaaactctcaacccctgaccagccttgggagcactgattacgaaggcaccccacatacttccttcataaacatttggcagatcaggaagtgctgaaaagcaatgcccctgggtctcagaagagaatactggtgggagaagaaatagaacattttccctcttgcagctgtcaaagagtgattatgtcaaatgggttttcaaggagccacgaagtaattacagggtaacttcttgacattattttccaatgtttgactcagcagatgatgatgaattgatgcatattattttatggctctctgaaactttgtttgatacttcagatagaggcagagctaagtcttcacttagactaacataacaaagttgccttaaatttaacatgttaactcc

SEQ ID NO: 45286 - DNA, 327 bp, Homo sapiens
aattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctcaaaaaaaaaaaaaa

SEQ ID NO: 45287 - DNA, 499 bp, Homo sapiens
ataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctg

SEQ ID NO: 45288 - DNA, 455 bp, Homo sapiens
gagtgaccgactgacattcctgggaaagtatcgcgagttccaccgtatgtacggggagaagcgttttgccgacgcagcttctctccttctgtccttgatgacgtctcggattgccccgcggtctttctggatgactctgctgacagatgccttgccccttttggaacagaaacaggtgattttctcagcagaacagacttatgagttgatgcggtgtctggaggacttgacgtcaagaagacctgtgtatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatggtggtttgcataaa

SEQ ID NO: 45289 - DNA, 557 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgctcttcctgtatattctctgtctggctgcacccttttcccgcccccagattgataagtaatgaaagtgcactgcagtga

SEQ ID NO: 45290 - DNA, 188 bp, Homo sapiens
agaattggaaagccttaagcatcagcaggatgcccttcggactgaaaaactccaagtcttaaagcaacaatatcagactgaaatggaaaaacttagggaaaagtgtgaacaagaaaaagaaacattgttgaaagacaaagagattatcttccaggcccacatagaaaaaaaaaaaaaaaaaaaaaaaa

SEQ ID NO: 45291 - DNA, 522 bp, Homo sapiens
caagcacaattaattttagggttgattttgcagtttgtgagctctctaggctttgcgcttctcttctgttcttctgtaacctaccatttcgatatggggggggtggggtggtattgcaacctcaataaaacttagaaaaaaggaaaggaaatcaggtgcctttgttcatttcttcaaaactttattgaacacttacttctgtcaaacattggtaagcacaaggaatgtggaaacctgcaattaacagacctgagacaactgacagttagggagtgtactggacattgatttctaaattcagatggtaaatagtttaacaaaggcaaacacagtaggggtgttgttgaagcacacacaaggaacagtagaaacaaattgcctgaactcggattgaagaataaggtaagagtcagtaaggaaaagtagtatgtgtgtgtgtgtgtgtgcctgtgtgtgcacacatacgcgcatgcatacacatgtgtatgaaagggaaaaaaaaaaaaaaaaaaaaaaaaaaaa

SEQ ID NO: 45292 - DNA, 533 bp, Homo sapiens
aggtggaaatcactacagaaatatttagcacaaggacaaatgatttaattagagacaatgacaatatttaatttattaagaataacttgtattttttttctttttgatttccatgttattatattatcatctttactaaccaagaaaaacttttttgaaataatgcatgtggaatatcagaatttgaatcttggttccactacttactggctgtatggcaatgctctggatcagagcctcagtatcaactatagagagaatgaaaggcagtggaataaaagagatagaaaggagaaaagaaagggaggacagaaaatacaatgtttgctgggaactttacatatgttatttcatagaattttcataaaataaccaagacaggaaaagaatttacttactttcccaattctaatttcacacaattcatagatttcaattttagcgtggagagatattgatgaaaacatgatgtggggcaagattgatgttagtcctacccatatttgggaggtggacagagtgggtgccagtct

SEQ ID NO: 45293 - DNA, 485 bp, Homo sapiens
ggaggtctggtagggctgagcttgcaagaggatcaacacgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaaaaaaaaaaaaa

SEQ ID NO: 45294 - DNA, 395 bp, Homo sapiens
tataaataaaagcttaatgtttgtaaaaaatctcttttttagtatttcttttttcacatgaaagaagtggtggctgctaaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaaaaaaaaa

SEQ ID NO: 45295 - DNA, 240 bp, Homo sapiens
gcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaaaa

SEQ ID NO: 45296 - DNA, 399 bp, Homo sapiens
atttgtgaaatgaaagtataagaagagcataccaatgcaataggcactctccacggcggtttgacggccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagca

SEQ ID NO: 45297 - DNA, 613 bp, Homo sapiens
aggtctcaagctgagcaaactgaaaactcagcagctcttcttaaacctgcgtgagacatgaggtcacaggcaagccactgtccccagatagggtggacaggtgaagtggagaatcaccatacactggagcagaaagctccaaggaacccccgctgggattggaaaacctgaactggaattgacaaattgctgtagtgaggttgtggccaagtctgagagttaaaacgtccaggaggcctgtgcatacagggccatgattttgtgagttgtccatcagaagctcaaccaggttctcgaagtaaatatcagggaagaatcccctcatacttactacaggggacggagaataggaatcattttcaaatatgcaggacactcttaactaggtctaccttccagagaagctagttaactagagactaacctggtggggtttatcaaagccttccggctggggaaaaggaatatccactccacctccagactgaaagcaagagacccttaaagcaaaagacagagtatcagcctatggacgctcagaagctaattatcggacgtatcagggagatgggacagagagttttacatatggtgattctaatatcgcacaact

SEQ ID NO: 45298 - DNA, 405 bp, Homo sapiens
gcacaccctgtaaaaaaaaaaaaaaaagattattttaggggaaatgtaggggtaaaattatcgcttatgccatttctaaagcagtggggcccttaaggcttaaaagaaggctagcattgttggcccaaaaagtgggggatccccaccccaaataggaaaaaaattacttcgggggggaaaactttttatgccatcgaaaaagcggaaaaaaccccttggtttctatttataaaaaaagggcttttctatatgccccttgataacagatttggaagaaaccctgaagaggataaagcatttgaatggccagtagaggtaaaaaaatccagtttaaaagaacattggtttttacataaaaggtttattggaaaacaaaggattttggacataaaggtcggttttccc

SEQ ID NO: 45299 - DNA, 299 bp, Homo sapiens
agtgctagtagtctttgatttatccatattgttactatattttatccaagatggagtttaggagacttaaaattctgataaatgcttttgtaataaggttagctgtaatacggattcttacagtgaatggtgtatttcagtagttatatttctgttgtagtgtaaactctgcaatctcaggtgctcctgttaatcatagttaagtatattttattgtcagatgttaaataggcataaggcactgatatataagaaatcaaatcagatattcaaatcattaaagctctctctgtttactg

SEQ ID NO: 45300 - DNA, 215 bp, Homo sapiens
atcgaattgaaaagctgtgcagtcttatcactcttgtcatgaagtctctgaacattcaaagccgactcctaactgtatatatatatacaccagtataaaaaaaaaatttaagtcagatttgcaaaaagttattttgagcaggtaaagaggaggaggctgtctaggttctaccaaagccaaagaataatagtaaaaacaaaaagcttcttttaaaa

SEQ ID NO: 45301 - DNA, 299 bp, Homo sapiens
agtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattg

SEQ ID NO: 45302 - DNA, 433 bp, Homo sapiens
gtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttgggttaatctgtataaaaattgtaagtagaaaggtttatatttcatcttaattcttttgatgttgtaaacgtactttttaaaagatggattatttgaatgtttatggcacctgacttgtaaaaaaaaaaaaa

SEQ ID NO: 45303 - DNA, 180 bp, Homo sapiens
gttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaaaaaaaaaaaaaaaaaaaaaaaaaaa

SEQ ID NO: 45304 - DNA, 528 bp, Homo sapiens
caaagagggagatgataagaaagagggaggtaaagacagagctttgaaaggagttttgcgagtgggagtattggcaaaaagattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagaccaccggacgtcttggacaggcaaaaatgccttgacgctctggctgctctacgccacgctaagtggttccaggctagagctaatggtctgcagtcctgtgtgattatcatacgcatctcgagactctgtcagcgagttcaacttggtctgattttcagctgggctatggag

SEQ ID NO: 45305 - DNA, 560 bp, Homo sapiens
gataaataaagagctctaagaagaaaatgtataatcttagagctgaaataaaatatagagaccatctagtaaatgacctcattaatatatctgtgaaaactgagactcagattgtatgtctctaagaacacataattagtaacagatcaagacacttaaaactttccctacaaaacctccctgccttgactttctctttctctttgcagatttctaggccgcttctgctcagtgtcttcattttcttccatatttgttttatttcatttttcttttctatagttcatgttttctttttccttggaaactcaaaatttaaacacacgtcgtgtgtgtgtgtgtgtgtgtgtctgtgtgtgtgtgacttaaagaatcttaagctttggcattaaatagtcctcgattcaaatctaagctcaacatctgagtaacttcattttcctatctgaaaaatggagataacattagaattgtgtagtattgaatgaaacaatgtatggaaagctcttatggttcttgtcacctaagaagtacttaataaatgataaatattttaaata

SEQ ID NO: 45306 - DNA, 468 bp, Homo sapiens
attaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaggttaatgggatggtcggatctcgcaggctgagaactcgttcacctccaagcatttcatgaaaaagctgcttcttattaatcatacaaactctcaccatgatgtgaagagtttcacaaatccttcaaaataaaaagtaatgacttagaa

SEQ ID NO: 45307 - DNA, 526 bp, Homo sapiens
gacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagacctgttaactactacgttgacactgctgtgcgccacgtgttgctcagacagggtgtgctgggcatcaaggtgaagatcatgctgccctgggaccaactggtaagattggcctaagaagccctgctgacacgtgagcatgtggaacccaaagatgagatactgcccacaccccatc

SEQ ID NO: 45308 - DNA, 597 bp, Homo sapiens
gaagccaagacgcaatatgtcatcatatgcattttttgtgcaaacttgtcgggaggggcataagaagaagcacccagatgcttcagtcaacttctcagagttttcttagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagaggtgtggaataacactgctgcagatgacaagcagccttatgaaaagaaggctgcgaagctgagggaaaaatacgaaaaggatattgctgcatatcgagctaaaggaaagcctgatgcagcaaaaaagggagttgtcaaggctgaaaaaagcaagaaaaagaagggagaggagggaagatgaaggaaaattaaaaaggattaaggagggaggagggaaagattgaa

SEQ ID NO: 45309 - DNA, 560 bp, Homo sapiens
attcacagtacatgtgtctgacaaaggacttacatcctaaatgcatttttttaaaacccattgtattatctagttgtgtaacagattaccacaaacttagtggctgaaatcatgcattgattatcccatagcttctgtaggtcagaagttcaggtacagcttagttgagtcctctgcctcaggctcttttgtgaagcttgcaatcaagatgttggccaggaccagggtctcatccgaaggctcagctggggaaggatccctttccaagctcatgtggttagtggcagtgtttagttccttgcaagcggttagactgagagccttagttcattgacatgggcctctcccgcatggcagcttgcttcaccaaagccagcaagatagtgatctgctagaaagacaagccacagtcttatgtatatagacagaagcttaataatggaagtggtgtcccatcacctgtgctgaatactgttggctagaagtaagtcactaggtcctgctcacactcaagaagagggatacacaagtacatgaatgccagggaggtgggggatcaa

SEQ ID NO: 45310 - DNA, 438 bp, Homo sapiens
gtccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccagggtgggacactaaaaaaatgtgtttatttcattatctgcttggatttatttgtgtttttgtaacacaaaaaataaatgttttgtttca

SEQ ID NO: 45311 - DNA, 256 bp, Homo sapiens
ataaggaaaatattcacaatatactgttaagagaaacattgagagtcaaaattgtgttcaatatgattataatgcttgtaatgataaagctcacacgttaacagcctggcagaaaatataccaaaatgctggtatccattgtgaaagtggtggaattatgaactgtttttttcctactttctatttcccatatatttagtaacataattatttacatctctaaaaaaaaaaaaaagaaaaaaaaaaaaaaaaaaaa

SEQ ID NO: 45312 - DNA, 325 bp, Homo sapiens
gatataattaagatgaggtcttattggcatagggtggccccctaattcgattgttgtacatataaaaaggggaaatctgaacacaaagacatgcacataggctaagtaccatgtgaagatgaaggcagagactggggtgatgcagcagaggccaagggacaccaaggattgccagcaaaccatcagaagctgggagcggcaaggaacagatcctcccccacagcccgcggaaggaaccaattctgccaaaatctaggacttctagcttcctgaactgtgagacaataaatttctgttacttgaaaaaaaaaaaaaaaaaaaaaaa

SEQ ID NO: 45313 - DNA, 608 bp, Homo sapiens
ggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattccttagtgttaaaatacagtatatctaataactagcctcattagtagagcagtatattaaaacaatgttttatgtaaaagtgttatcctcagcacaaatacatgataaatgtatcaatcactattataaacagagcttcaaacactctcagaatatctcaagtatttgatgaagtaacttgtaa

SEQ ID NO: 45314 - DNA, 300 bp, Homo sapiens
gtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacagaaaaaaaaaaaaa

SEQ ID NO: 45315 - DNA, 525 bp, Homo sapiens
catgtttacacagcgtgcaggcagccctgctcggcgtcaacgccaacgcactgctgcacgacgagcgattcctcaacaacattggctggggaacagaccagggaattggtggatttggccaagcgccgggaattaaatcacacctcatgaaccttattcgatctgtaagaaccgtgatgagagtgccattgataatagtaaactcaattgcaattgtgttacttttagtacttggatgaccatcactggagaaaatggagactcagaagaggacatgccagtagaagttattactttggtcattaatggaacatttatatcttagctggctgaccttgcacttgtcaaagaatgtaaagctgaaaataaaaccagggtttctatttatctgttttttttttcaccgttgcacttgtagtttcattacaaaagatcagttcaggaaaggcagtaactccccaggactggaatatctgattgctcaagtgtataaaattcaagccgtggggagattgtaaaaggggg

SEQ ID NO: 45316 - DNA, 303 bp, Homo sapiens
ggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgcgccaaagctttactactgtggaaagacaactgttttaataaaagatttacattccaaaaaaaaaaaaaaaaaaaaaaaa

SEQ ID NO: 45317 - DNA, 264 bp, Homo sapiens
gaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttccaaaaaaaaaaaaaaaaaaaaaaaaaaaaaaa

SEQ ID NO: 45318 - DNA, 593 bp, Homo sapiens
gtagtgaagagttggtttcttcagacaaaattatagtactgaagctttccaaaaggggagtggatactggatagcaaaaaacagtgaagttccactactctcagattgacatggtatgataccagaagatgagcaagagcatggaggataatggaggataagaagaggcttcttccttctatcaccttcagatcctatcccttcttccgctaaattctccataattctaattgatttcacttgactttcaggctacatccagccaatgccaagacagtggagtgggactggaaactgctcacctatgtcatggaggaagaggtaacaacaattataagattatatcttctgtaggggaagttttaactataaagaaaagtgataccaggtgccatggctcacacctgtaatcccagcattttcggaggccgaggcagtaggacagtttgagcccaggagtttaaggccagcctgggcaacaaagtgagaccctgtctctacaaaaataaaaataaaatatttagccaggcatagtgatgcatgcctgtggtcccagctacacagaaaggctgaggcaggaggattgcttgagc

SEQ ID NO: 45319 - DNA, 499 bp, Homo sapiens
gatgacttacccacaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggcca

SEQ ID NO: 45320 - DNA, 546 bp, Homo sapiens
ggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggattgggagcacgatgactctgagtttgagctattaaagtacttcctacacga

SEQ ID NO: 45321 - DNA, 570 bp, Homo sapiens
ggattcaagggaggcaggcgctttggaagtttgtaaacaccgactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaaggctttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgcgtccattgtttaaatgtaatgatattggacaaaaaaatttacagcaaaattaagtcagttctgctgaaactggatttttggaattgg

SEQ ID NO: 45322 - DNA, 536 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaacaagctggccaaggtgtcctgcaggctgtaatgcagtttaaa

SEQ ID NO: 45323 - DNA, 460 bp, Homo sapiens
ataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcaaaaacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgggtattccaagacatgtctgttctacatagatgcttagtccctcatgca

SEQ ID NO: 45324 - DNA, 489 bp, Homo sapiens
  misc_feature 2, 5, 7, 8, 11, 12, 21, 22, 25, 29, 31, 34, 41, 42, 53, 54,59, 65: n = A,T,C or G
gncgngnnggnnagttaatanntgntctnantgngaaaganntccggccttannggcgnagggcnccctccttgaggaagagtgagggttccaacttttctgcttatctggtaggtgttgggcgcggacagtcgagatgtcagagaaaaagcagccggtagacttaggtctgttagaggaggacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtggtgaagtaacctaaacttgacctgcttaatacattctagggcagagaacccaggatgggacactaaaaaaatgtgtttatttcattatctgctgggattatctgggtttctgtacacaaaaaaat

SEQ ID NO: 45325 - DNA, 282 bp, Homo sapiens
aagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcccaaaaaaa

SEQ ID NO: 45326 - DNA, 730 bp, Homo sapiens
aatggatttcaaaatcaacaccgatgagattatgacttcactctagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggttagctacggcaatcctgaacttcctgaagatgccttgatgtgcagctggcattccttcgactctctccagccgagcttcccagaacatcacatatcactgcaaaaatagcatgcatacatggatcaggccagtggaaatgtaaagaaggccctgaagctgatggggtcaaatgaaggtgaattcgaggctgaaggaaatagcaaatcacctacccagtctgggaggatgggtgcccgaaacacactggggaatggagcaaaacagctttgaatatcgacacgcagggtgtgagactacctatggagatattgcaccctatgaaaatgggggcccgaaaaaaaaattggggtggccgttgggcctttttgcttttattaaccaaccttt

SEQ ID NO: 45327 - DNA, 510 bp, Homo sapiens
ccgagagtaaatcatctttccaatccagaggaacaagcatgtctctctgccaagatccatctaaactggagtgatgtgtagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaaccttctgcttcacttaagtgtctggcccgcaatactgtaggaacaagcatgaacctggtactgggatattttaaatatcccagtactcactttttccaaatgatcctagcaattgcctagaaatatctttc

SEQ ID NO: 45328 - DNA, 201 bp, Homo sapiens
agagatggctcagcagttaagagcactgactgctcttccaggttcctgagctcaattcccaacaaccacatggtgacatgcaaccatctgcactgggattcgatgcactcttctagtgtgtgtctgaagacagctgcattgtactcatataaataaaaaaaaaaaaaaataaccccttccgacaaaaaaaaaaaaaaaaaa

SEQ ID NO: 45329 - DNA, 213 bp, Homo sapiens
ctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaaaaaaaaaaaaaaaaaaaaaaaaaaa

SEQ ID NO: 45330 - DNA, 460 bp, Homo sapiens
aagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacgtttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctcctcccttccctgaaaaataaagtgtgggaagagacaag

SEQ ID NO: 45331 - DNA, 110 bp, Homo sapiens
ggacaaccttagccaaaccatttacccaaataaagtataggcgatagaaattgaaacctggcgcaatagatatagtaccgcaagggaaagatgaaaaattataaccaagc

SEQ ID NO: 45332 - DNA, 275 bp, Homo sapiens
gatacatcaaaccaatggaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctacctcagca

SEQ ID NO: 45333 - DNA, 184 bp, Homo sapiens
gctctactaaaatacaaaaaattatccagcatggtggcgtacgcctgtagtcccagctactcaggaggctgagggcaggagaattgcttgaacccaggaggaagaggttgcagtgagccaagatcatgccacatcactccaacctgggcaacagaacaagaacccatctcaaacaaacaaacaa

SEQ ID NO: 45334 - DNA, 459 bp, Homo sapiens
gtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtagaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgcaa

SEQ ID NO: 45335 - DNA, 442 bp, Homo sapiens
atactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggacagtagtttagaaattacaggaccagcttgttacagattatacactattctgttacttttatttctgaaacttaaaaacaataaattctttttctgtgtttctaggttataaaaaaaaaaaaaaaaaaaaaaaaaaaaa

SEQ ID NO: 45336 - DNA, 440 bp, Homo sapiens
ggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatg

SEQ ID NO: 45337 - DNA, 280 bp, Homo sapiens
aaccttgtaaatcccagctatgtgcgtctttgtcgcaccactatgtgagactagcgcctgcacacagggcatgaccacacagttcgacaattctgatgcatgttaacgtgtttgcagtcatcatattatggacacaaatgacattgtggttaatgactgatgaaaagcttacgtatatgcctttggaacttatagagaccatcacaattgggtcttccttgcacgccccattacgtttgctatcactgataaccaaagctattttttgttaacaaaggtt

SEQ ID NO: 45338 - DNA, 405 bp, Homo sapiens
gatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgctttccaaattaaagaactccatgccactcctcaaaaaaaaaaaaaaa

SEQ ID NO: 45339 - DNA, 402 bp, Homo sapiens
cttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacatt

SEQ ID NO: 45340 - DNA, 98 bp, Homo sapiens
gctaccagagctattcaagcagtagtatttgaaccactagccttttaaataaaattctgccccattactgatgtgcaaaaaaaaaaaaaaaaaaaaaa

SEQ ID NO: 45341 - DNA, 309 bp, Homo sapiens
atttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaaaaaaaaaaaaaaaaaaaaaaaaaaa

SEQ ID NO: 45342 - DNA, 366 bp, Homo sapiens
ataacacaaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaagagggtttctgtacttacctggtttgccaagtatgccagtgtaatgaaactgcccttattttaaaagccagtcaaagattccactgattgacatttgataaataaacatcaggattatgtttataaaaaaaaaaaaaaaa

SEQ ID NO: 45343 - DNA, 562 bp, Homo sapiens
caatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtacagttagccactgctggtgttatgtgaacattcctatcaatccaaattccctctggagtttcatgttatcctgt

SEQ ID NO: 45344 - DNA, 299 bp, Homo sapiens
tccctactacctgccaccccacgcttaatcagtggtggaagaacggtctcacaactgtttgtttcagttggccatttaagtttactactaaaagactggttaatgataacactgcatcgtaaaaccttcacaaggaaaggagaatgttttgtggaccactttggttttcttttttgcgtgtggcagttttcagttattagtttttaaaatcagtactttttaatggaaacaacttggccaagactttgtcacagaattttgagacccattaacaaagttaacgagctttggattttgtt

SEQ ID NO: 45345 - DNA, 414 bp, Homo sapiens
tcacaaaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgattcatctgcctttgtggctgctgcccctgtggctgctgccaccacagctgctcctgctgctgctgcagccccagctaaggttgaagccaagggagagtcggaggagtcggacgaggatatgggatttggtctctttgactaatcaccaaaaagcaaccaacttagccagttttatttgcaaaacaaggaaataaaggcttacttctttaaaacgtcaa

SEQ ID NO: 45346 - DNA, 500 bp, Homo sapiens
gctcaggcttaagtaaaaggaggctattgacatggactcttgttaggttttgttccccaggatcgcaacaaaataggaactactgtttaatgagtgcctactacgagcttgacaccatgctgggtactttatgtacaggtctctaatccttaattttctacaacactgaaaatatgatggatttttcccaaagtacaaaaacacccactgccctcagaccaccatgagccaataggaaatacacaatgctcaagaataacatactctttccgccaacgatgcaacctttggtggtaccagtgtacgtctcttaaacacacagtgagaaatcctcactctactcacactctggtcattattaccctaaactcattgccttggagtctcaatcagcaactataatggctttttagatggaaatttaagtcatttagcaacacacagaaaagtgttggggagaagtccaaaaacatttcaaacttggcccatggccctttcca

SEQ ID NO: 45347 - DNA, 180 bp, Homo sapiens
atagcaagtcacaggatcatccccaagatttatcattgcactgtagtctgccaagagccgagacagttggagttaaattccatctcagaagtgaataaatgaatctacataaactgcagagatccctgaatctacttccctatcggtcaagtaaaaaaaaaaaaaaaaaaaaaaaaaaaa

SEQ ID NO: 45348 - DNA, 273 bp, Homo sapiens
gggcactcccgcaatcaagatgggtcaccacgcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacattgg

SEQ ID NO: 45349 - DNA, 629 bp, Homo sapiens
caacacatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgacagcaatcaa

SEQ ID NO: 45350 - DNA, 507 bp, Homo sapiens
gaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggatataagtaatcatattttgtatgtattcgatttaagcatggcttaaattaaatttaaacaactaatgctctttgagaatcataatcagaataaagataaattctgatcagctca

SEQ ID NO: 45351 - DNA, 312 bp, Homo sapiens
atcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaaaaaaaaaaaaaaaaaaaaaaaaaaa

SEQ ID NO: 45352 - DNA, 248 bp, Homo sapiens
ggactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagctccgacgtctgctgggacagaaagaacaacccggagccctggaaccgcctgagccccaatgaccaaaaaaaaaaaaaaaaaaaaaaaaaaaaaa

SEQ ID NO: 45353 - DNA, 396 bp, Homo sapiens
catcatttaatgattcaccaatttcttgcattaatttgaatttaacgcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggcgtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaaaa

SEQ ID NO: 45354 - DNA, 581 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaagattaattgggagtggtagg

SEQ ID NO: 45355 - DNA, 636 bp, Homo sapiens
aaaacgacttcttattggcctctacaactactccagtcaggtcaagaatgggtctcacattgccagatcagtgggtatttttagtcttcatcttagatgacctttatgcacatttgtctttgtctaggaacttctgttggaaacatcttctaatttaaggttattttaaattttttttgcatttggcacattatgcttagcatgtgtgtccaactctttgacaatttctttttagttttctggtggcttccctttatccaaatttagtattgaaattcctcgagccgctgcttttctcactccataattctggccagaatttggtacttaaaatattttgtctaaaatattacaatagctacttaagtcatctccctgactccactctgttgtctttcagggcgtcgtccacactgtagccaaagtgatcttataaaaacataattctaatcatggcactcttctgcttaaaaatgttttaatggctttccgttaggttaaaatttaaaagtcctttgtagcctgtgagactctacatgagttgactccctagctcatcttgagcatctaattcttacttatatacaacagttagagtgattgtaaatatcacagaagtgaatcggtcgattaagc

SEQ ID NO: 45356 - DNA, 535 bp, Homo sapiens
gagagaagcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtacaagacatgatggagaaggtgatgtggctggagatgatgatgatgacgatgatgattcacctgatcctgaaagtccagatga

SEQ ID NO: 45357 - DNA, 497 bp, Homo sapiens
ctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgta

SEQ ID NO: 45358 - DNA, 508 bp, Homo sapiens
agttgcgggcggtgctttgcttgtcgagactgagagttttcatgcagcatgacgctccagaggctcttcaggttctcctctgtcattcggtcagccgctcagtccatttgcggaggaacattggtgttacagcagtgcatttaataaggaacttgatcctatacagaaactctttgtggcaagattagagaatacaaatctaagcgacagacatctggaggacctgttgatgctagtcagagtatcagcaagagctggagagggagctttttaagctcaagcaaatgtttggtaatgcagacatgaatacatttcccaccttcaaatttgaagatcccaaatttgaagcatcgaaaaaccccaggcctgaagaaataaagtaaaattaatctggtaatttggcacggattaagttgtcactaggtagaaggttcagaataaacatgcatttcataactgtcaaatggtcttttaatctgaggccaaataaattatttgggggatggcc

SEQ ID NO: 45359 - DNA, 233 bp, Homo sapiens
agcccttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaacca

SEQ ID NO: 45360 - DNA, 292 bp, Homo sapiens
agatgaagtgcaggttaccactacagatggcacagggtattcttcacaaaaggtattagtcactgtaccactggctttactacagaaaggtgccattcagtttaatccaccgttgtcagagaagaagatgaaggctatcaacagcttaggcgcaggcatcattgaaaaggtgactgaaatgacctcatcctcagcaagaaagagattaatgtcagatgatagatgttaacttctgatatggagaagtagtgggtactatctaaatacaaataaaactcaaggatttcctttt

SEQ ID NO: 45361 - DNA, 590 bp, Homo sapiens
catgcacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaaggtaaaggttgaatgtaccactttatttaaaagggttttttctttaatttaaatgaaatggggtgaaggaacatgatttggtgccatgtcggaatacagatcacatgcattggagaatcggggagggctttgggaacttaattttacatatccagctctgatgatctgatagcaagaaaacaactctgctgcttatgagggtccagacgcggctgtctggc

SEQ ID NO: 45362 - DNA, 389 bp, Homo sapiens
acgatctctctttagatatatgcgattgaaatttactgctggcgcaatagatatagtaccgcaagtgagtagatgaaaaattataaccaagcataatatatcaaggactaacctctattccttctgcatcctgaattaactagaaattactctgtgagttgaggcaattgctaagacccccgatccagatgagctactcctgcagattttgagaacaccgctctatttcggacagctcactgtgaattggttggtactggagtgtacaaccgggggcggaagactcgtgtccatattggaatatgaaaatttgctatcgactgaaccgtaaagcctggggaaagataaggggtggcagaacaattcctattccagattggctgtaattg

SEQ ID NO: 45363 - DNA, 594 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaagggagagtcaacatatgtgattgt

SEQ ID NO: 45364 - DNA, 276 bp, Homo sapiens
aatcaagcaatccagcctcatgggaaagtcctggcacagttttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaaaaaaaaaaaaaaaaaaaaaaaaaaa

SEQ ID NO: 45365 - DNA, 586 bp, Homo sapiens
ttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactccacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcaccccccaccctcactgggaattctcaccaaaaatagtttgatacttaaaaaacaagaagtaaatacttttctcaatattgttttggctatgcaaatatttgttttgcttaatgtcctcatttacacttctcagcaaatgtagttgcaaacaaatgctttctttttatttttcccttggg

SEQ ID NO: 45366 - DNA, 598 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacatttggaga

SEQ ID NO: 45367 - DNA, 387 bp, Homo sapiens
gagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtat

SEQ ID NO: 45368 - DNA, 655 bp, Homo sapiens
aaatggaagcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaagaattctctttggtcattgagggaccaaaaaaggacgtaaaatttacagtcaatctatgagggttttttccctccataagtttactttaaaactgtatttaaggaatcaaatcttacaaaatcctggaagattttggtaatgatgttgatcaattcagggaaattaatcaagtacctatattgattaaaagtgtattttatcagtagtttgagatctgcatggagatactagcccagcctagcagaaaagtgcatatgtatagcatactt

SEQ ID NO: 45369 - DNA, 300 bp, Homo sapiens
ggaacttaattcaaataagcaaattatagagagaaaaaaaacatattagtgaaatttgaacatggacaataggtgtttgatattaaggaatgattgttacttctggattgtgtgtgtggtaatgggattattgttatatttaaacaaagaaggggagtgtaggtggcagtaatagataataatagccataaattgataatcgctgaagatgagtgataggtacatatgtgtttgctatctgttctttctacttttgcatatattatttccgtaacaaaaaaaaaaaaaaaaaaaaaaaaa

SEQ ID NO: 45370 - DNA, 593 bp, Homo sapiens
acaagtgtgccctaggctctcatggttgccagcacatttgtgtgagtgatggggccgcatcctaccactgtgattgcaatcctggccacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgtcattgccaatgttcctgctaataatttgccattatctgtattaatgcttgaatattactggataaattgtatgaagatcttctgcagaatcagcatgattcttccaaggaaatacatatgcagatacttattaagagcaaactttagtgtctctaagttatgactgtgaaatgattggtaggaaatagaatgaaaagtttagtgtttctttacctaccaattgagccattt

SEQ ID NO: 45371 - DNA, 230 bp, Homo sapiens
cccacactgctgcccaggaaaggtgcgctgcattaatagagaggattttttcctgctgaataccttgaggagttggccaacacgtttgggagtagaagtagaaagggccaggtgtgatggctcatgcctgtaatcccagcactctgggaggccaagtggggaggattgcttaagcccaggactttgaggccagcctgggcaacagagtgagactccatctctaaaaaaaa

SEQ ID NO: 45372 - DNA, 460 bp, Homo sapiens
cagtaaagtctttagacatgactgttgatgtcattatccatgttacctaacatatatcataccacgtatacttgtaaatggactctgtcgcctggctcacaataagggaaattatagtatgatagaagaggtaatcttttcaccgcatactatagcaaggactaacccctacaccttccgcataatgaattatctacgaaataactttgcaaggagagctcacagcttcagacccccgcgaaccacctcgagctagttaccgaacagctcacaagcccgcacccgtctatgtgacaccctggtgcgaggatttatccgtccagggcgacacacctacggcgccgggtgtgcggtgggtgtccctgagagaatctgagtctcagctttggactggtccgtttcaccctcgacagcccagtgtcagtgtaactgttagcccatgaccggcacagcggggctg

SEQ ID NO: 45373 - DNA, 408 bp, Homo sapiens
  misc_feature 408: n = A,T,C or G
atatacaataatgtaatttagtctaacacagttgaccctattttttgacacttccattgtttaaaaatacacatggaaaaaaaaaaaaccctaaatgcttacggtgcacctaaagcttttttaaaacaacgtctttttgtttgtttgtttgggatcctttaaatatatattattcccatttagggccccctttacccaaaaccccattacggcttcatttttgtaaaaacatttaatttacatattttccaaatatgggaacggcaaaaataaaatataccatctttcatacggtaggaaccaaaagggaaactttcctttaaccccctttttacactttagggaaagtaccagggggggaaatgcatttaaagatcatttcaaggcaaaattgtgaacctaaggacn

SEQ ID NO: 45374 - DNA, 261 bp, Homo sapiens
ttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggca

SEQ ID NO: 45375 - DNA, 630 bp, Homo sapiens
ttactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatctgtagtttaatgttgttattaacagtaataagtggatttttgt

SEQ ID NO: 45376 - DNA, 431 bp, Homo sapiens
tatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggaaaaaaaaaaaaaaaaaaaa

SEQ ID NO: 45377 - DNA, 249 bp, Homo sapiens
acatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctcaaaaaa

SEQ ID NO: 45378 - DNA, 553 bp, Homo sapiens
ttacaggagcagaaacatggtatgccagacgttggggatgctggtataacttgtgggactgaatgtgaccgatcaactggcaatgcacctggcttcactgcacatgtgattatcccgaaccacccaggccaaataagcgccggctaggcccctgtcttggattgccacacggctcacattgcatgcaagtttgctgacctgagggaatagattgatcgccgttctggtaaaaagctggaagatggtcctaaattcttgtagtctggtgatgctgccaatgttgatatggttcttggcaaagcccatgtgtgttgagagcttctcagactatccacctttgggtcgctttgctgttcgtgatatgagacacacagttgcggtgggtgtcatcaacccagtggccaagaaggctgctggcgctggcaaggtcaccaagtctgcccagaaagctcagaaggctaaatgaatattatccctaaatacctgccaccccactcttaaacagtggtggaagaacggtctcagaactgttgtttcaattggccatttaagt

SEQ ID NO: 45379 - DNA, 504 bp, Homo sapiens
ggaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaat

SEQ ID NO: 45380 - DNA, 403 bp, Homo sapiens
acggatagaagaaagcaaatacgaattgtactagttgtaccaaatcgttgggattcattggcatgacaatttcagtgtggtgtattactcaaatagaaaacaaacattttgtttcctaggttgagggtctaattgatacgttagccctatgatgaccatttaccaactttcaaatgattctgcgttcaacatatagcaagaccagcagtcaggctttccacctatacggggtcagctgtggcaggctcagtcgtaccggctggacaccagccggcgcgccgtggtacccttctttttcagctgttcctgccggcctttcctgcacccaccaagagtggtgacatttacatgcactcgtagaattacagtaccggcttaattccagcagacgggaaactaataa

SEQ ID NO: 45381 - DNA, 447 bp, Homo sapiens
gggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaaaaaaaaaaaaaaaaaaaaaaaaaaaaa

SEQ ID NO: 45382 - DNA, 104 bp, Homo sapiens
gagagagaaaagctaaaaaaaaaaaagtaaggggtgagcagttaatggtattcattccacatacaatatctgtgtaaaacgatttcctgtagaagtagctttaa

SEQ ID NO: 45383 - DNA, 306 bp, Homo sapiens
agctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagatttaa

SEQ ID NO: 45384 - DNA, 601 bp, Homo sapiens
agcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcgacttagaggtggggagcagagaattctcttaaccaacatcaacatcctgggcagatttgaactcctcaatctcctgcactcaaagcttgttaagatagttaaagcgtgca

SEQ ID NO: 45385 - DNA, 367 bp, Homo sapiens
tagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttcctctgcacttatcatcttcacaattcctaattctactgactatctagaaatcgctgtcgccttaatccaagcctacgttttcacacttctagtaagcctcacctgcacgaca

SEQ ID NO: 45386 - DNA, 160 bp, Homo sapiens
agcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttcca

SEQ ID NO: 45387 - DNA, 195 bp, Homo sapiens
ggtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaa

SEQ ID NO: 45388 - DNA, 531 bp, Homo sapiens
atccctgttttacctttgaagacattaagacataatgaggttaaatagttcttgtgtcatgtagtaagtgaaatctgtgatttggacccttttggaacttggctactgctaactacatattcccagcttcaagggggtcagagatggagaaagccttggtattggtaaacattagtaatgtccacatatactcctaccacaagggtatgaaattgcctgtgtcactgtacctttctagtcctgggtatcacagatgctacaatttttaattggtgaaaaatagtatttcaatgtaatttgtaatttatttaataataaggttatacaatgtatctttattgggcatttgtatttcttttttttgtgaactgtcttcgtggttttattggatagttttatttttaataatttttataagctttctgtaaaataaagaaattagattttgaattctcctaagcattgcaaatgtcttctagtataagcattttaatgactgtattttacattttatggtgatatatagttatg

SEQ ID NO: 45389 - DNA, 450 bp, Homo sapiens
tatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttgggtttgaaatttgtactgtttctatcataaataaagttatggcttcttgttggg

SEQ ID NO: 45390 - DNA, 279 bp, Homo sapiens
  misc_feature 172: n = A,T,C or G
ttccgcagtaggggcaggcggatcttgaggaaaccacagcctgatttttttcgctttgaaagataaacattagtacaacgacttaaataaataggtgtcaagcccctgtccacagataattgcattatacggtgagtttttaacgtaattttaatacacttaagattttaanagaaaatatgaagacttatcaacagtagcatgaggaaggaaaagataaaaggtttctaaaacatgacggaggttgagatgaagcttcttcatggagtaaaaaagtgt

SEQ ID NO: 45391 - DNA, 327 bp, Homo sapiens
atttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaa

SEQ ID NO: 45392 - DNA, 476 bp, Homo sapiens
gtgtggcttggtcactacgctgtcccaacgtactaacgctgtctgctgaattctaattctgtggcactgagccatatcaagatcgcgtgctcgcacttaactccataccgtacatggttcacacctgttgtacatagaggccgtcttgtctgtgagcgatcttccaccaatgaaggctggcaagaaaccagttgttttgtcttgcgggtctgtcagggttggaaagtccaaagccgtaagacccagtttccgcttccctaggctgatgtctttggccagaacaccgtgggctgttacggtgcgttgagttggaagcggtttgcatttacgcctgtaaatgtattcattcttaacttatgtaaggttttttttgtacgcaattctcgattctttgaagagatgacaacaaattttggttttctactgttatgtgagaacattaggccccagcaacacgtcattgtgtaagaaaatct

SEQ ID NO: 45393 - DNA, 298 bp, Homo sapiens
ctaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacct

SEQ ID NO: 45394 - DNA, 299 bp, Homo sapiens
gaggcattgaggcagccagcgcaggggcttctgctgagggggcaggcggtgcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtgt

SEQ ID NO: 45395 - DNA, 584 bp, Homo sapiens
catggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtgggttatggcaaaatcaataagaagcgaattgctttgacagataacgctttgattgctcgatctcttggtaaatacgggcatcatctgcatggaggatttgattcatgagat

SEQ ID NO: 45396 - DNA, 485 bp, Homo sapiens
taatgtccagaggatagactgaaactctgtgataaacgtgagcaggcagcaggatgctacctgataactgagtataacagcatgcaggggaggactgtgtggctggaggcagctgcagtagaagttggcagtgccactgtggacttttaaagggacaactctgggtacaagcctgaagtgtaaggaggacataaaattaaatacaattgagcttgtctccttgaaaactggttctctttttttactacattaaaaagatcaagtggacagttaagtcattaattcaggtaattccaatcacaaaactacttttttcctgaagtgtcctaatcattgatttttaaaaatgatatttctttcatcataaattatcagcataattgctttggttccatatttcatattaagcttgggctgagtgatgtttaaagcctcctgcttaccttccccccttttcttcctattttattttacctaatacccac

SEQ ID NO: 45397 - DNA, 302 bp, Homo sapiens
taactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattca

SEQ ID NO: 45398 - DNA, 270 bp, Homo sapiens
atcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcacagtatccatattttagtactgtttattacttccatgaattttaaaa

SEQ ID NO: 45399 - DNA, 604 bp, Homo sapiens
agatatattcaatagtagaaaagtagtaaaaataaaccctgcaggtatttgtttatccacgctttcataattgtcaactgaacatttgccaattctgtttcttctgtactcccacttacactcccctcccttcaccccattgcaataactaatttttctttagtttacaaactagagattgcagagggtaataccaatactaatgtaaacagaataactctttttttaatgtggcgtgtttctgggtatgaaatttaaggaaataggacagaaagttaaaaggtatatataaatgaagacattcataattgttgatacttgtgaaaaacagtttaaagcaaataaaaatatctaataaatagcgaggtaaataatgtatcaatctaatagaatattatacaccaattttaaattattgctgtcaagcccatgtggtgacatggaaagaaatattttaatatgagcttttaaaaaacctaccaacatggtgaaaccagtctctactaaaaatagaaaaattagttgggcatgggtgctatatacctgcagtgccaggtagtcagggtgtctgagacacaaggaatagaatcgcttaaacctaggg

SEQ ID NO: 45400 - DNA, 474 bp, Homo sapiens
aactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcataatccgtgaaaaa

SEQ ID NO: 45401 - DNA, 662 bp, Homo sapiens
agatcagatacaaagatatagaaacctaaactagggaagcagtgaaagtagataacatgttcctacctacaggatggactcgcttttgtatgatctaaaggagaaaacatggctaatcattaagagtccaagactgggtagttgagaaaatagtgatgccattaatttaaatgcagagataggggagagaatctggtcttgatattgagcttggttctggacatttttttttaattcaagcaccaccaggaatttcgggtggaaatgtccagttgacgagcagtgggaaatacaggtggggatccctagtggggacacagtacttaagtatggatttgatagtcatttccacagaagtattagaaaaatataatgtggagacagagattctgagtttgctcctgccttacactagctgtatgctctaacaagactctcaacttctctgagcctctgccctctcatttataacatgggatcaaaaatatatatatcattctacctcctcatagggttgatgcagactaaaatgagatactatctgagaaagtgctataaaaacagctgttatcaaaaaaacattagtgctttatatatgtcaaactatcctaggaaactatcgaataattttttttctcagtaaaattatactatgcagatta

SEQ ID NO: 45402 - DNA, 325 bp, Homo sapiens
ggaggcttattccagtactgccatcttcaggtctggtaatagaagagtgtttttttcctgccaatgaaaggattatgagtgttactaaaaatcttccattatatgatgcctggaaaacctcttgggctcggaatctcattaataaacaaatttaggaacagacatatatgcagcctggcagtggtgacgtacacctttaatttcagcacatgggaggcagagacaggtggatttctgagttcgaggccagcctggtctatagagtgagttccagaacagccacagccagggctacacagagaaactctgtcttgaaaaaaaccca

SEQ ID NO: 45403 - DNA, 427 bp, Homo sapiens
gacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatctctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaatt

SEQ ID NO: 45404 - DNA, 300 bp, Homo sapiens
atgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcaaaaaaa

SEQ ID NO: 45405 - DNA, 250 bp, Homo sapiens
gattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaaccgttcctccattatttgaattactgaagacagcaagatatttgtaaattatcttaaaatgaacaacttaaaaaaaaaaaaaaaaaaaaaaaaaa

SEQ ID NO: 45406 - DNA, 613 bp, Homo sapiens
gatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataagctgcagctatagttgaacaagcagtctttaaaaactgctgtgaaacacaggccatcagggaaaacgaaatgctgcactattaaattagaggttttgaaaaatccaactctcacctgggcagagggtgctagttggtatagaatgttagtttcagaaagttactttgcttagtcataagtctattgatgcgt

SEQ ID NO: 45407 - DNA, 627 bp, Homo sapiens
ggtgtttggcgtcggaattaaacaaccaccatgtcgagcaaaaaggcaatgaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttccccacctcatagaac

SEQ ID NO: 45408 - DNA, 560 bp, Homo sapiens
gaaacaaatcatttgctttatatgtttcattagaataccaatgaaacatacaacttgaaaattagtaatagtatttttgaagatcccatttctaatcggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgacttgttaacgtgcctaaagctctaaatataggtgaatgtgtgatgaatactcagattaattgtccctctatataattag

SEQ ID NO: 45409 - DNA, 509 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaggg

SEQ ID NO: 45410 - DNA, 200 bp, Homo sapiens
gaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccaaaaaaaaaaaaaaaaaaaaaaaaaaaaaaaaa

SEQ ID NO: 45411 - DNA, 256 bp, Homo sapiens
aaacaaagtgttaagtatatgattattaagcatatatacctatgcatatatagagtcctatatccttttttaaatatatatttttctcatccatgagttgtaattgtgttcttcattttactgttactctatatatgcataggtatatatgcttaataatcatatacttaacactttgtttcccaccacaggccacctgcagaccctccattctcctactccagtctgggcaaacagtgagactctgtctccaaat

SEQ ID NO: 45412 - DNA, 520 bp, Homo sapiens
aggcaaggttaccatgagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactccagcccttataacttatgcattgtcatcagtggggagtcctaaagcgaaggaagctttgaatatgctgacttggagagcagaacaagaaggtggcatgcaattctgggtgtcatcaagagtccaa

SEQ ID NO: 45413 - DNA, 534 bp, Homo sapiens
cacgcatttatattttctaccaattaccttgatagaaatatcttagaaattgctgacctggaacggttgtgagaagactcctggcttctttcttgcctcacttaacaaatattttaaggtcaaagcaatatctgtgcacggctttccttttgctcctccagacaagtgaggctgttggtatagtcctcttcaccctctgcatgtagcttcaccctagatcagacttttgtctcttgggtcccagatggcacaggagcactgcatgcttgttttctagagcccagccagtcatgggtgctagcctagtctccacacaccagcaagtagaacccaagtgtattgtataaatatttcctgagtaccagtaagagaatgcattcttttctcatctaggccaggaatgttgaaaatgctcagccttacatagaaactcctagattttcactaacgcatttcacaaaagtaaataagtatttcatataattcagaggatgtttaaattgtcagcattttaataaatacttgtaaaaaaaa

SEQ ID NO: 45414 - DNA, 525 bp, Homo sapiens
aattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttataaaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggagttatatcaagttctagtgttgctctagtaactgaactgaattacagttctgtcct

SEQ ID NO: 45415 - DNA, 521 bp, Homo sapiens
taataaaaatttgggtaaactcatgtatcgcagtaaaatcttttatgaattgggtgggccctaaaaacatctgtagtacgtgatgtgtttggttagattcagccaaaccgacacccgtatgctaagactgcattgtcattctgacaggaggcaggcctcagtagttgcagtgagtgcatttactaatataaggatccttctttgtagtgacaacaaaaatgagattgtaacttaatcaaatatgagtcagatatagtaattcctgatattgcagatgaaagagcagggtcttttcaagtgcttgctacaactgactaaatttgaagctttttatgtaaaagttcttctcccagatattttaaaccagtatgttaattatttcctagaatgaataattctccttttttgatagatttttgaaattgttttacttactacttacatactttgaacaaatatgtttttctaatcccagcattaaattgaaacaaatatttaaaataagatggtgggaataaagt

SEQ ID NO: 45416 - DNA, 492 bp, Homo sapiens
gggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccggacagcattggaaaagacatagaaaaggcttgccaatctatttaccctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgcaatttacgaa

SEQ ID NO: 45417 - DNA, 485 bp, Homo sapiens
aacaatgcctggcacttagcaggtgccagacaacttagctttcttttctataaaaggtttttaggaggaaaacaagatttttttttatctaaaatacttttcacaagggtttttaaccaaagggccaaatctggcctacataatgtttgtaaaaatcatatttgaagtaattgccaactttaaacatcagtaactgtcacataaaaatctgtatttctcacttatcttgaaaaagtgtattttctggcacagagcttccccagttctgcttggaactccaggcagaagctgagtattggctgctgctttggacacagcatttgctaaacagctcactgcagtgctttgaatgacttctctaggcctctgcacctggaacttcttcactatgttacccttttcctaatgaatcttcatttcatgatattttcaccaaagaacaatagaatctgtaaaaataaatacttgcagtgcttaaatgggaa

SEQ ID NO: 45418 - DNA, 549 bp, Homo sapiens
atcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtc

SEQ ID NO: 45419 - DNA, 358 bp, Homo sapiens
ggagggctggagacttagaggtggggagcagagaattctcttatccaacatcaacatcttggtcagatttgaactcttcaatctcttacactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgaaaaaaaaaaaaaaaaaaaaaaaaaa

SEQ ID NO: 45420 - DNA, 410 bp, Homo sapiens
taagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttaccg

SEQ ID NO: 45421 - DNA, 237 bp, Homo sapiens
tacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgacaaaaaaaaaaaaaa

SEQ ID NO: 45422 - DNA, 250 bp, Homo sapiens
aagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttggccttaaaattggtggaaatccccggtagcaccttggctttttaataaacgtaccccaaggggggtcctggccccttaaggg

SEQ ID NO: 45423 - DNA, 617 bp, Homo sapiens
agagaagatcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatccctagtaattgcctagaaatatctttctcctacctgttattatcaaatttttcccagtatttttatacggaaaaaattgtattgaaaacacttagtatgcagttgataagaggaattggg

SEQ ID NO: 45424 - DNA, 171 bp, Homo sapiens
cctatttttaaacagcctaaacttttatgtaattttgaaatattacggaagcggtacttaattgaccagttggagaaaattgagctaattagtgtccttagggtgctttttactgcactgatgaaacaaatgtatttaaaacctcactacttcctatctacatgtagtggg

SEQ ID NO: 45425 - DNA, 272 bp, Homo sapiens
atcccctctctaccctaccacttaggctagaattatctgctgggatatttccggacacatttgggtggggatcaaagtcctgtccaccaccaaaactaagttcttagattttgggggatttttttttttttaaacgatgagaagggaatccggttatgttgatttctagggtacaaaatactggcggcggggggtctggatttttttattttttgaccaaccgtatggaaagttgcagaaaaacctttgacagaggatggttttttaaaaat

SEQ ID NO: 45426 - DNA, 109 bp, Homo sapiens
gaacatttaaaagtttccctagcgggccattccttaccaaaatgttggaatccctgttgctacattgactaaaaggtcatgatgaatggaatatgtaagacgtggctca

SEQ ID NO: 45427 - DNA, 209 bp, Homo sapiens
ctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttgggatttatttgtgtttttgtaacacaaaaaataaatgtttggg

SEQ ID NO: 45428 - DNA, 489 bp, Homo sapiens
ataaatatgtataaacatagaatacagttgtttccaaaagaactcaccctcactgtgtgttaaagaattcttcccaaagtcattactgataataacattttttccttttctagttttaaaaccagaattggtccttggatttttattttggtaattgtaactccatctaatcaagaaagaataaaagtttattgcacttctttttgagaactatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaaaa

SEQ ID NO: 45429 - DNA, 239 bp, Homo sapiens
agtgaagaaactttttggatgatttctgttggtgggttttggataccttcaagggatcagaaaataatatacttaggaaattttggtaatgtcatcattactctctacattattattatgacggttacaattgttaaatctaggtggtgggtatgtgggttagattgtacacgatttttaacttgtctgcatgtttgaaattataacaaagtcaataaataaattattgagacactcct

SEQ ID NO: 45430 - DNA, 342 bp, Homo sapiens
gaagtcaggccttgaaaagaggatagaccacgctgtggaggagtggcatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcgagacatttgtagactcaaatgctcaatttactgagaatgttttcctgcctatgttaatatgtcagaaaaaaa

SEQ ID NO: 45431 - DNA, 457 bp, Homo sapiens
ttatcaaatattaagaatatttaagttttatttaactaaaagcatgtatctcaatattttattaattaacttcctgaggcactgaagatacctactttggtgaacatgtttttttaaaaaaaatagatttaaattattgttttagcctaaaaatgtataaactagaacatttattataattacagtacttaagactctaaaactaagaatgttaatgtccaaccatatcttttatttttcatttgctttttggtggaggtggttttgtcatgtgctcaccataaaaaacctacaggcaccaggatatttactgaagcaataaaaaactggatacattataaatgaccatcaacagaagactagttaaataattaggatatagccatataatagaattctatgcatactttaaaagaaattgagtacatttatacaccgatatggagacattcgcttt

SEQ ID NO: 45432 - DNA, 371 bp, Homo sapiens
ggcggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaaactccagctgtgaaagcaacataaatggattttaaactgtctacggttcttaacctcatctgttaagttcccatgcctggagaagctaatgccaactcatcatgtgataattcaatttgtacaataaattatgaacctgg

SEQ ID NO: 45433 - DNA, 340 bp, Homo sapiens
catcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgctttccaaattaaagaactccatgccactcctcaaaaaaaaaaaaaaaaaaaaaaaaaaaa

SEQ ID NO: 45434 - DNA, 122 bp, Homo sapiens
tgaagaaattcaatgaagcttgtgtatccattatcatgtgtaatcaataaacgatttaattctcttgaaaaaaaaaaaaaaaaaaaaaaaaaaaaaaaaaaaaaaaaaaaaaaaaaaaaaaa

SEQ ID NO: 45435 - DNA, 570 bp, Homo sapiens
gcatcaccacaccgtgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaattttagatgtcagtttgggaggcctttcccccctcaaatgagagcccctggtattcagagctccaagactaagaac

SEQ ID NO: 45436 - DNA, 388 bp, Homo sapiens
gagacctatggtgaaaatgatgaaaatactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcggcacccaatttctagacaacgctcagccaacggattcttttcaagctgctcaaacataaatctgcctactgaactctaggatatttaattacaaaaattaagaacttagacttttttaaaacttttgtattagaaatgcgcatacatttatatgaatatattttgataacgtaggtctagagcttcttttatattcaagcacaaaaaaa

SEQ ID NO: 45437 - DNA, 560 bp, Homo sapiens
attgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcaggcatgtataaacagcgcctgccacccaggacagtgtgagaggagacctacctgggagactgagactttcccccacttttagcttgatgttaaagaagtggttgtaccttcctaaatcgaatagtctaaatgaatcagtagtttttatcattttcctgtagcctgcaatttttctttctctagaaaggcatcatgtcattcaggagacaaaaagaaacaaatcctttttatagtcatacattcactatcatagtacccaaaaa

SEQ ID NO: 45438 - DNA, 410 bp, Homo sapiens
gtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttccaagttgaaaataaagtgtatattttttctataaaaaaa

SEQ ID NO: 45439 - DNA, 147 bp, Homo sapiens
aaggatcaatctagataatgtaagaacactctgaagatataaagtgtttggcaagattacggagggctgcccatgattaaaatagaggggagcagggattgggtaatatactgaaatagacattcaggagagggctataccccgatc

SEQ ID NO: 45440 - DNA, 580 bp, Homo sapiens
  misc_feature 577: n = A,T,C or G
ttaatctatgtgtttatcgaatcaagacattaactttggcaacagatgagaccaccaagcttaagagagctaaactgtatgtggaaattaaagaatattaataatgaaggagccaccaaaatagtctacacatgtgtgaacaatctcttgggatattagacgtgtttaaagaccagtgttgctgctatttttaatattttggttaatttaagtgaaatgtacatattttaatttgaagatttatcttgcccatcagaatgtgaagatatacttgcatatattttgacatatttcatggaaaataaaaatgataatccactttgtgagtgtaagtgaatgtattcatatgtatgttattataaatgatttttgtttgcactgatgatgaaatgagagttttgggggctttttatacatttatatcgactggtctctaaatctcctattttgttttcttaacatttttgaaatacagttcccattacatgagttttaaatagattggtgtttcattttgtattatgctactactagatgttgattctctggtattgtaaaataaaatgtgctccaaaanccc

SEQ ID NO: 45441 - DNA, 254 bp, Homo sapiens
gttttttcttatagtatcagcttcaaagattcatgagccgctgtgctggcctgatttttaagttttagaactcagtgagtcttcaaaccagtgcagatctgtcactataaaaagctgccaccaggcccactcacacctgtaatcttagaactttgggaggctgaggcgggattgcttgagcccagaagtttgagaccagcctggacaacatggtgagaccccatctcttgaaaaaaaaaaaaaaaaaaaaaaaa

SEQ ID NO: 45442 - DNA, 240 bp, Homo sapiens
aagtgttgtggtaatacaataaccaaaattgaacacacagttttaaagctttttatatttagtagcagttgaatatatatggcatgttttacatagattaattttactatttttctttatttaaaaaagagaaccaaattgaaagccgacagatactgcagatgactgggatttttgtttctgtcttatctttttgtgttttttttctgaataaaatattcagaggaaatgcttttacag

SEQ ID NO: 45443 - DNA, 387 bp, Homo sapiens
ggagaatgtttacagcttgtttttatgaagcccttctaatgagagatctaagctaagggattttaaattgaagaggttaaatccccatctacttaacttttaattagttttttgtttgtttgtttgtttgtttgttttttactattttactaaaatccaggcattcatcttactgtttgcataagtacaagcttcactttaggctcaagattgaataaaaatgcatagcaaatttgctttaaattaatgtttaaaaaatcacattgcacatttgtccctgaaataagtacagaaattactatcattttgccatattaaggcaagtactaaagctgtgatatgaagaaaatgtcatattaaaaaaaaaaaaaaaaaaaaaaaaaaaaa

SEQ ID NO: 45444 - DNA, 253 bp, Homo sapiens
agttgagcccagttcaagaccagcctgggcaacatggcaaaaacctgtctctcctaaaaaatgaataaatttagctgggtgtggtggtgtgtgcctatagtcccagctgcactggaggctgaggtgggcagatcacctgagtccaggaggtcaagactgcaatgagccatgattgcgctactgcgctccagcctggactccagcctgggtggcagagtaagatccagtctcaaaaaaaaaaaaaaaaaaaaaa

SEQ ID NO: 45445 - DNA, 205 bp, Homo sapiens
aatggaaacgctggaaatctgcagggggagggagaggggaactgttatctcccaagattaaccttcacttttaaaaaattattgtacatgtgattttttttttcctgttcatacatttgtgctgcccatgtactcttggcacatttcaataaaattgtttggaaaataaacacaacaaaaaaaaaaaaaaaaaaaaaaaaaaaaa

SEQ ID NO: 45446 - DNA, 639 bp, Homo sapiens
gtagttgagtgaaccacatttttctttagtgtgcctttagtgaaaaatgactaattgaatagaattgctagcaccagaacttcagctttcaaaatactaagctatcgctgtgaaggagacagtcctgaaatctgtgaccttggatcaggcacaacaacctatctgctctcaggcaccaaaagcagacttgccgagcaaatattcctggagtcaatttcctgatgaattctttagggtctatgtccataactgtccttcataagaatgagggatgcttaattttgtaggatactaaatggtttggcttatctgctttctccaaaatacatgctgaaactgtaggaaagctcatggccgaatgaatactcgtataaggagaagactaaagaggtcatgggcaagagcacataatagatatccacaaggggccagcgccacttgggcaggacctgaaggccaaccaagactgtgaatccccaagccaaggtagctgagaacagagaaagtcaatgactcctgtagaagcattctcttcatctctttgggaagccttggcaagggtactgtggctattgaagaaaggtttgctttttggcaacactgaaacagatttaaattcatattgaaacaaatgacgca

SEQ ID NO: 45447 - DNA, 358 bp, Homo sapiens
atgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaaaaaaaaaaaaaaaaaaaaaaaa

SEQ ID NO: 45448 - DNA, 244 bp, Homo sapiens
atttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactaaaaaaaaaaaaaaaaaaaaaaaaa

SEQ ID NO: 45449 - DNA, 179 bp, Homo sapiens
gcaggaaggaaggctgaaaaagcggacgaagattttgacttaagtgggactttgtgatttaattttttcttttttttaagtggggaggaaggggaagctagatgggctaggagagacttgattttggtgctaaagttccccagttcatatgtgacatctttttaaaaaaaataacaaca

SEQ ID NO: 45450 - DNA, 469 bp, Homo sapiens
gacggggtttcaccttgttggtcaggctggtcttgagctcctgacctcatgatctgcccgcctcggactccccaagtgctgggattgcaggcatgagccaccgcgcctggcaaaataagataatttctcaaaataatttggtttcatataactggagtagtaattaatattttaacttcatcaactagatgtatctcctcagtagcatagtaactggtacatccagaaatctgaaatccgagttacttgatacaaattctactttatctaaccattagttattaaggaggtaaaatcttgttctaatttgctattaaaatcttattggttaaatagaaataagaaaaagtataattaagtttcttcatcctcaatgtcaactttatattgtaattaaatgtgtagcaaccaagctgacaatagtgattaagaaattaaagtacagaaatattttatttggggacccaaa

SEQ ID NO: 45451 - DNA, 577 bp, Homo sapiens
gtctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttctataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgttctctttgattaattgcatgttatgtttaataagctactagcaaaataaaacatagcaaatgg

SEQ ID NO: 45452 - DNA, 563 bp, Homo sapiens
ggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaa

SEQ ID NO: 45453 - DNA, 427 bp, Homo sapiens
ggtgctctcaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctccacacacgggtaaagaacatgttgactggat

SEQ ID NO: 45454 - DNA, 573 bp, Homo sapiens
gtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggcaaagcaggcggatcacctgaggtcaggagtttgagaccagccgggccaacatggtgcaacctcgtctttacca

SEQ ID NO: 45455 - DNA, 270 bp, Homo sapiens
accagtgaaaaaaggtgaaggtgccgagctataaacctccagaatattactagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaacacttttttcca

SEQ ID NO: 45456 - DNA, 419 bp, Homo sapiens
aatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgtagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagact

SEQ ID NO: 45457 - DNA, 495 bp, Homo sapiens
caaggaagacagtgtttctttagttcccatattcatctaattcatggggttctaacattttggggggccatagattcttttgacaatctgagccaatctatgaaacttctccccaaaaagaaccaccccacaaaatcttgcaaaacgtaagagattttcctggatctgaagctacccgaagacatgggaagagttgtattctattattcaattttaagaatatttattaatattcactgagctattgctagccactgtgctaaacattttacatacattctcctatttcatcctcaaaacaatcctttgagttgggttttaatatagttccaatattcgggatgtgaaaactgaggcttatagtggctaagaaacttgcccaaagccactacctagaaaatggcagagctggaatgtaggtttaacttctgaccactatgctataaagtcaccacatgtcaaactaattttcaagttgttggggacatgtcccct

SEQ ID NO: 45458 - DNA, 521 bp, Homo sapiens
agatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaa

SEQ ID NO: 45459 - DNA, 369 bp, Homo sapiens
gagttttaatgcatctttgaaaagtaacaacagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaagcagtgcagtccttatggagcaaattaagcttcacaaaagtgacataag

SEQ ID NO: 45460 - DNA, 535 bp, Homo sapiens
gagtttttatcaaatgaaggaggaagatgtacaactacaaatatccattaatttaaaacttcatgaaagtgtgaaaaataattttgaattctgtgaagcccatatacctttttacaatataggtccaagttacacatttggaatacaaaactacgttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctcagtaacatatggatcattattattgtaatagtctcatgtttaaatgggattatataa

SEQ ID NO: 45461 - DNA, 165 bp, Homo sapiens
tgccaggatggcctttggatctctcttccaagcctttcctgacttcctcttagatcatagattggacctggttttgttttcctgcagctgttgacttgttgccctgaagtacaataaaaaaaattcattttgaaaaaaaaaaaaaaaaaaaaaaaaaaaaaaaaa

SEQ ID NO: 45462 - DNA, 600 bp, Homo sapiens
ggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctgggaaagtttttctaagactaagtgaagaactgaagggagtcctgcatcttttttttttaaccgcctccggtttaaaaagccaacattcctctgcttcaaaggtgttcctgcatttgaggtgtaatgaaatccttggcggttcaccaagatgtaaaggtttttagttcccttaa

SEQ ID NO: 45463 - DNA, 459 bp, Homo sapiens
gtccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccat

SEQ ID NO: 45464 - DNA, 362 bp, Homo sapiens
gggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactgcaaaa

SEQ ID NO: 45465 - DNA, 742 bp, Homo sapiens
ggagtgacccggcgtggctactatgagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacgagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtaaaggagcttcctcaacccacgaaaaatacctaaacgtctagatgagtacacacaagaagaaatagacgccttcccaagattgtggactccacctgaagattatcggctataagagaataagaattgcagaaaataacagtgaaagtgattgaaactttcttctgatgagttctcaacctacaggatggggtaaaacaactgctacagttcagcacctgtttttatgtgcgaaatcactgtgggggaaaggcagggaagg

SEQ ID NO: 45466 - DNA, 174 bp, Homo sapiens
cagtgctgtgttggaaagacagtgatactaattgaggtcagaaagcttccccagggaagttgggtgtggtggcacgcacctgtagtcccagctacagctactggggaggctgaggtgggatgatcacgtgagccaaggaattcagcctgggcaacatagcaaaacccagtctca

SEQ ID NO: 45467 - DNA, 573 bp, Homo sapiens
gatctattttaaaaattaatatattattctttatcacaatttaaaatggttgctctagaaataggaaactattacgaggatgtaaaggcaaactatagacactgagaacattttgcaaatagcatacctgacaaagaatttgtatccagaacatataatgaactctcaaaactcagcaataagactacgatttaaaaataattttaaaaatcaatagtaagaagatttaaaaattggcaaaatatttgaacagatacatcaccaaagaagatatgtggatgtcaaataagcatatgcaaagatgctgaatagcattagccattaggaaaatgaaaattaacaccacaatggcataactattagaattaatggcactttggaaaattgacagtaccaacttatgtcaaaaatacagaccaagaggagccctcacactttgctcttaaggatgccaaatggtgcagtccttctggaaaacgcttttgcagtgtctttgaagctaaccttactgtatgatccaacagttccactcctgagtatctgccctaattaaattaaaactttattcacaca

SEQ ID NO: 45468 - DNA, 545 bp, Homo sapiens
gattcttcccctctctacaaccctctctcctcaacgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggagttttgcaaaaaaaaaaaaaaaaaaaaaaaaaaaaaa

SEQ ID NO: 45469 - DNA, 472 bp, Homo sapiens
ggctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaatagatgtggatttgtgctcctgtatttttaagtggattaaaaaacttactacccaa

SEQ ID NO: 45470 - DNA, 529 bp, Homo sapiens
gacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaaa

SEQ ID NO: 45471 - DNA, 565 bp, Homo sapiens
agcattagtagagagaaaaaataaagtgttgaatttgaatattgagttttagcaattagatgtcttaaatgttattgttttttctcaggaagtccgctccagtgatgactgtgaaatcttatttatagaagattgaatgttgtagcagatgatagaccattgtgaaatagcagatcaaataaacgtttttcctgaaatgtcaaaaacttcattactggagcatcttgtctccatagagcatgtaattaattatgaaccaggagtaaataatatattttacaggacttttgtcatttatctgggtgccatgttttataaacacaattattcactagtagtctttcaattctgcctttattacatgatgatctgctaattcagaatgagaaatttccacattaagtacttggcaaggactgggtgtgggaagctcatgcctataatcccagctacttgggaggctgacacaggagaatcacttgaaccctgggaggctgaggttgcagtgagctgagatggagccattgcactccagcctgggcaaaaagcgaaattccatcctaaa

SEQ ID NO: 45472 - DNA, 181 bp, Homo sapiens
ccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaaaaaaaaaaaaaaaaaaaaaaaaaaaaaa

SEQ ID NO: 45473 - DNA, 375 bp, Homo sapiens
ataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagccttggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 45474 - DNA, 747 bp, Homo sapiens
  misc_feature 637, 640, 644, 647, 652, 654, 660, 677, 682, 699, 712, 714,717, 741, 743: n = A,T,C or G
gcccaattgagtgcttcatgcctttagatgtacaggctgacagagaggattcccgagagtaaatcatctttcaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaaaatccacagtactcactttttccaaatgatcctaagtaattgcctagaaataaccttccccttaacctggtaatttaaccaatttttcccagtaatttttataccgggaaaaaaattggttttgaaaacnacnttantantggcnantttganaaaaagggatttggggnaaaantttgggggggggggggnaatttttttaaangnggnggggggcaaaaaccttttaaaaangngggg

SEQ ID NO: 45475 - DNA, 283 bp, Homo sapiens
gtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcgaaaaaaaaaaaaaaaaaaaaaaaaaaaa

SEQ ID NO: 45476 - DNA, 364 bp, Homo sapiens
agacatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaaaaaaaaaaaaaaaaaaaaaaaaaa

SEQ ID NO: 45477 - DNA, 438 bp, Homo sapiens
gctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctgg

SEQ ID NO: 45478 - DNA, 374 bp, Homo sapiens
gaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttgc

SEQ ID NO: 45479 - DNA, 168 bp, Homo sapiens
gggggtatagctcagtggagagcatttgactgcatgtgatgggtggggtggggagggaatcactggtgctatagaaattgagatgcccccccaggccagcaaatgttcctttttgttcaaagtctatttttattccttgatatttttcttttttttttttttttgggg

SEQ ID NO: 45480 - DNA, 329 bp, Homo sapiens
gtccatcagtatcagtgcctgcctgagttaggaaaattacattcctggatctgtattgaggagaaggatgtataaagcagcatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacacaaaaaaaaaaaaaaaaaaaaaaaaa

SEQ ID NO: 45481 - DNA, 269 bp, Homo sapiens
gcatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatactattaaaactgcttttttttttccagcaagtatccaaccaacttggttctgcttcaataaatctttggaaaacctca

SEQ ID NO: 45482 - DNA, 486 bp, Homo sapiens
atggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattggttaaaatgcctcttttaaaagcttatataaatttttttcttcagcttctatgcattaagagtaaaattcctcttactgtaataaaaacaattgaagaagactgttgccactt

SEQ ID NO: 45483 - DNA, 579 bp, Homo sapiens
gaggaggcggcgaatcacttataaatggcgccgaagcaggacccgaagcctaaattccaggagggtgagcgagtactgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggccgggtagatcctactgttgaaaatgaggaaacattcatgaacagagttgaagttaaagtaaagattcctgagagctaaaaccgtggcttgttgatgactgcggacttaattacaagcaaaaacagctcttttatcttcctgc

SEQ ID NO: 45484 - DNA, 376 bp, Homo sapiens
aagagaggacaatactactgacttttccaaaataaaaaggattataaggaattatatgaacaaatgcatgctaacaaattaaataacttagttgaagtggaccaatttctagaaagacacaaaataccaaaactgattcaagaataaataaaaaatcaaatagacctataatatataaaaagattaactagttattaaaaacatcccacagagaaaagttgaggaccagatgacttcactggtgaacgctaccaaagggttaatgaagaattaatgccaatccttcacaagctcttccaaaaaataaaagaagatggagcactccccaactcattctgtgaggccaggcctactctgataccaaaaccgaaaaaaa

SEQ ID NO: 45485 - DNA, 364 bp, Homo sapiens
gtgaacatgaaagtacttctcatgtgtccttgagaaatgatgttgctagtgcagtgtttcacaattcattttctactaaatgtgtaccattttttaaattgttttaacagaaatatagagtgtgtttcttaggaaatagaatgttatgctttggggctcctgaaacacctcgttttgaaggtgaatctttggttttctcccagaagagggtctgccttgggatgactggagctcttaccatcaaaatcagttattcaagtgcttgcccagtgcttcttgaaactcacctctactctgtattttctacagttggttcttgtgttataaatgttgtgagcaacagattaaatgatgctgaggaatg

SEQ ID NO: 45486 - DNA, 468 bp, Homo sapiens
gtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttgggtggtgtacagaacacacttaagtgtgttaacttgtgacttctttcaagtctaaatgatttaataaaactttttttaa

SEQ ID NO: 45487 - DNA, 583 bp, Homo sapiens
gattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaagggtcttgaagaagggactatataaatacaaaataatatctattaaagttgggtta

SEQ ID NO: 45488 - DNA, 180 bp, Homo sapiens
gacagcactggaagcagggtacagtagcccaaagaaaaagacacatttgggaagaaaagcaggaaaaacgttaaagaaaatgtacttaccacctggactcaaaaggcagggattggataggaagaggaataaaatataaaaatcagagaactgttgaaattctgtgacccctttttagtt

SEQ ID NO: 45489 - DNA, 750 bp, Homo sapiens
aagagcaagtactttaaaacagaggatcaaaagtagagactgccagtaagcgctccacagtgctccctgggcacggtgatttcatcccgtgtactctcttgtcactctgtatctcccatcctaactcagacccaagcacctcaatttgatgccttggctgacatacagaaggcctttcataattatatgtctaatgaacaaatagttaatgaagagtaactacttggtgctaactttgaaacttttatttaggtttcaaaaacgatataaagagtgcttccacattttgtcattctttaaataagcccctcctcttagaagcactagtgaatatattcacatttaattttggaggcatcatttatctcataatttaatttaactcaatcacccaatactatgatttgaagtaaaaaataaaaccctgtgatggcctttatcctttttaagactcatttacttaatatgaaagagttatatatttttttgtttcctacattattatttgtatgatatgtaattttgaaaaaatctatagatatttgccctacatgtattccttaaatgtgattaaacctgattatcatctaaaacaaacaaaaaaaggaacaggatcttacatgctgaaatgattcaaagaaatattaatctggcaacatagcaaagacatggaatcaacctaaacgcccatcagtggtagacgggataaagaaaatgtgtacatgtcactaagggatactacccagccat

SEQ ID NO: 45490 - DNA, 697 bp, Homo sapiens
ggaatcatagaatagcatatgactgtgaatccaatttacgattatttttacgagtatttttccaagcagtttcaccattattcggacagtttaattgccacaccttttcaaaacctggtattacagagtaaaagaataaagagacgatttgagttttcagtttcattttcaaaaactatttaccaaaacacatggccaagaaccatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgttcttctttactaaggatactattcaaaaattaacattttcatcccagtaagtttttagaacatcaaaatgttttctgagctccaagtggctaggttgtaaaagtttataataatttgcaattaaaatacatgatacatattaatccattaaagactagtgggaatgtacagccagagtagcaagtaattttgttttataaatcaaaggtaactgtcatcctgcagta

SEQ ID NO: 45491 - DNA, 327 bp, Homo sapiens
acccaaacacttctgctttcacttaagtgtctggcccgcaatactgtaggaacaagcatgatcttgttactgtgagattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 45492 - DNA, 583 bp, Homo sapiens
gagacagagctggaatatcagaagtctcggcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgttca

SEQ ID NO: 45493 - DNA, 482 bp, Homo sapiens
gataagaagaaatggagaaaaatatatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcatcgtattgatttgtactggtagtttatgaaatttaattaaaacacgggccatgaatggaaggtggtattgcacagctaataaaatatgatttgtgg

SEQ ID NO: 45494 - DNA, 153 bp, Homo sapiens
gttggaggagaggaagaaagagagacagaggattgcattcatccgttacgttcttgaaatttcctaatagcaagaccagcgaagcggttgcacccttttcaatcttgcaaaggaaaaaaacaaaacaaaaaaaaaaaaaaaaaaaaaaaaaaa

SEQ ID NO: 45495 - DNA, 170 bp, Homo sapiens
ggcaaaagactgcaataaagtttcagaatacaaagtcaatgtccaatagtcagtagtatttctatatagcaataatattcaagctgagaacaaaatcaagaactcaatctcatttacaatagacacacacacacacacacacacacacacacacacacacacacacatat

SEQ ID NO: 45496 - DNA, 371 bp, Homo sapiens
gacacgacaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatattttttttttcctgaatgagaaaacatgaggggaaattggtg

SEQ ID NO: 45497 - DNA, 601 bp, Homo sapiens
gacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagggtgccattttttttttgttcaaatgattttaattattgggaatgcacaattttttta

SEQ ID NO: 45498 - DNA, 278 bp, Homo sapiens
acgaaaaagtacatgtaaaagtacatttgatgacagtagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaaaaaaaaaaaaaaaaaaaaaaaaa

SEQ ID NO: 45499 - DNA, 598 bp, Homo sapiens
gagacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtcccacattggatgatattccactttgggaattttagtatttgtatatagaaaatgggtttaataactcacatggtttgatttgtctc

SEQ ID NO: 45500 - DNA, 604 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaacccgaaggtgattaaaagaccttgaaatccatgacgcagggagaattgcgtcatttaaagcctagttaacgcatttactaaacgcagacgaaaatgggaaggattaattgggagtggtaggatgaaacaatttggagaaag

SEQ ID NO: 45501 - DNA, 495 bp, Homo sapiens
attctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgta

SEQ ID NO: 45502 - DNA, 238 bp, Homo sapiens
ggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactaaaaaaaaaaaa

SEQ ID NO: 45503 - DNA, 321 bp, Homo sapiens
gattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgg

SEQ ID NO: 45504 - DNA, 660 bp, Homo sapiens
ggaggcattgaggcagccagcgcaggggcttctgctgagggggcaggcggagcttgaggaaaccgcagataggtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaat

SEQ ID NO: 45505 - DNA, 453 bp, Homo sapiens
atatgtacagttatctaagttaatttaaagttgtttgtgtctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttcta

SEQ ID NO: 45506 - DNA, 608 bp, Homo sapiens
gagacagtttcactttgttgcccgggctggagtgcagtggcatgaactcagctcactgcaacctcctgggttcaagcaattctcgtgcctcagcctactgagtaactgggattacaggcacctgccaccatgtttggctggtttttgtttgtattttagtagagatgaagtttcaccatcttggccaggctggtctcaaactcctgagctcaggcagtccacctgcctcagcctcccaaagtgctaggattacaggcatgagccactgtgcccagccaacacccatggatttttttagaacacctttttctcttctgctttttccttcataaacattctttcaagtgtacacagggtgcccaaggctacaccttagatacctgaatccagtgtctcctaaaattcagatgtccaagggttcagggacatgtccagagacttggttgttgtaggagaaaatataaattagaaataagaggctttattctcctacctgaaaataatggaagatattttgttcttttttcctaaagcatttagattatatgtagatatttttctctgattttggaaatatatgtaaatcatagtaacagctaaataaacca

SEQ ID NO: 45507 - DNA, 384 bp, Homo sapiens
gatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcctaaaaaaaaaaaaaaaaaaaaaaaaaa

SEQ ID NO: 45508 - DNA, 513 bp, Homo sapiens
gtgaactaagacacattatgatcagtaatttaaaatctagtcagtactatgaaaagaagtgggagatgaagtagccactagaaaaatccatgtataatttaaatatttcttatgaaataatatgaaatacatatattatcaaatcttactgctaaaaccatatgtaataggttatctggttcattaatacaagatgcatggttactttttactgtccttcctcaaaactcatttaataggtatatcatatcttggtatttaaattgtatttatttcatcatggagataaaagagagtgtgaggagtcagcatacttattttcattttgattttagttcttttatatcattcatcctaatgtttccctgtattaactaattccaactttttcagtgatgcctattacgtctttagtttccttaattaattatttaagatggactcttactcttttgtccaggctggagtgcagtgctgtgatctcctgactcactgcaacctcggttccagacc

SEQ ID NO: 45509 - DNA, 600 bp, Homo sapiens
acagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttccctgaattttaatttgataggcaatacatctacccactccattattttttaaaacttcatttaatagtttaaacaagattggttttgttttcaatttttattcactcttcatagaatcacaattacctttatatatcatatgttaatgggagagattccccagtaaa

SEQ ID NO: 45510 - DNA, 467 bp, Homo sapiens
gatatgttcactgtaattacttattttcatacatatacctacctaaattatttataaaagctttgctgaataaatataaattattaactccacaaatatgggggagtagaaaacatagaagtaaggtttatgattacttaaatcattgagactgctttctttagagtgtcataaccattctgcttctttcaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggtacatgtacaagcttttctttcaacattagcatggcatgtaaactccctaagtacaagatttatattgagctttatttctcctaaagggatgtacactaacctgccca

SEQ ID NO: 45511 - DNA, 431 bp, Homo sapiens
ctttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcagcggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaggctttgtaggacacttgtacttagtttgggaaaaaaaaataaattgaaattgttaggcttttgtatttccatttcttgcaaataaatattttttcttaaatagc

SEQ ID NO: 45512 - DNA, 154 bp, Homo sapiens
attgcagatgcttaagtcaactattttaataaattgatgaccagttgttaacttctgttggtttttattcagaatactggcagattttaggaatataaaggtgtactatgagacttccacttttcaggtggaatatatgggcaaaaaaaaaaaa

SEQ ID NO: 45513 - DNA, 610 bp, Homo sapiens
taggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtccctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttaatc

SEQ ID NO: 45514 - DNA, 446 bp, Homo sapiens
attccattctagaccgatagcttttatttttacgtttggaactattacaaattgtgctgctctggacattctcgaacatgggttttgggacacacatgtacacttttctgttgcttatacctaggaataagattgttggattataggtgatgcacatactcagttttaagatatgttgtcagacatttttccaaagcaattgtgccaatgcccgtgcctaccagtaatgtgtgaatattccatttccttcacatcttcagcaacacttaatgatgccagtcagaatttgcatttccctgatagctaacgaggttgggcatttttacatgcttgctagctgttaggatatctttctttatgtaatatcccttcagatgtttgcatattgattaatccgactgtctttttccagttaatttttcctttgttgaataaatatgttgcgc

SEQ ID NO: 45515 - DNA, 501 bp, Homo sapiens
agccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagctgctggcaactgaaggctggaacacttgctactggataatcgtagcttttaatgttgcgcctcttcaggttcttaagggattctccgttttggttccattttgtacacgtttggaaaataatctgcagaaacgagctgtgcgtgcaaagacttcatagttcccaagaattaaagg

SEQ ID NO: 45516 - DNA, 243 bp, Homo sapiens
atttgagctcaggaattcaggaacagcctgggcaacatggcaaaaccctgtctctgtaaaaaatacaaaaatttgccatgcatggaggtgtacgcctgtagttccagctactcaggaggctgaagtgggaggatcacctgagcctgagaggtcaaggccatggtgaaccatattgtgccactgtactctagcatgggtgatggagtgagaccctgtctcgaaaaaaaaaaaaaaaaaaaaaaa

SEQ ID NO: 45517 - DNA, 549 bp, Homo sapiens
attcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttcaaaatacatcc

SEQ ID NO: 45518 - DNA, 321 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaaaaaaaaaaaaaaaaaa

SEQ ID NO: 45519 - DNA, 298 bp, Homo sapiens
ctctacctcacactgtacacaaaatggaattcaaaatggatcacaagtatacaaatatataagaagttgtctttattattagtttttagatataacactttgtaccatccttgtgaaaaaaatacttatatttgataattagcattaaaatcttttgctctcagaaacactgttaaaagattgaaaagatgagccatagactgggagaaaatatgtaaaaatcacatattgaataaagggctttgtagaatgatacaagaaacttgtaaaacccaacagtagtaaaaaaaaaaaaaaa

SEQ ID NO: 45520 - DNA, 392 bp, Homo sapiens
ggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctaa

SEQ ID NO: 45521 - DNA, 248 bp, Homo sapiens
agcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaaaaaaaaaaaaaaaaaaaaa

SEQ ID NO: 45522 - DNA, 645 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacatttggagaagatagaagtttgagtggaaaactggagacagaagtacgggaaggcg

SEQ ID NO: 45523 - DNA, 145 bp, Homo sapiens
gggcttttctgaagaaaccacccactgtgatcaatagggagagaaaatccacattcttgggctgaacgcgggcctctgacactgcttacactgcactctgaccctgtagtacagcaataaccgtctaataaagagcctacccaca

SEQ ID NO: 45524 - DNA, 350 bp, Homo sapiens
atagtatttcaagatacttgaagaatgttgatggtgctacgaagaatttgagaagaaatactcctgtattgagttgtatcgtgtggcgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttctaaa

SEQ ID NO: 45525 - DNA, 563 bp, Homo sapiens
atatcagaatgattctgctcattgtttcatgcataagcccacatttgactagtttatctttgaatgtttgccattctcattttgtttgcactcctttgggtaatattagttacctgatgaagggactctcctgtatttggaattccaagctcttccaacttcagaatgccatgtctttactacatatattatgtagtactgttaaacaatcagtttgagatctgtagcacaattcacagagcaacaatctctcctgtatttccaaataaagtctttgaagggaatgatatttgcagaatgtgctatagtggtaaatttagagagtacaagataattacttgtaattatggcaatttctgtaagggaaatcatcttaatttgttcccactaagaaatagaattgctctactcatagcgtgtgaatctttttaggagattaatgcggtgtgccttcattactttgaatggacattacagcttttcactacatctgaaattaccccttaattcatgcttctgtttgaatttctgctaaatgcagtcttcacaaaaaaaaaaaaaaa

SEQ ID NO: 45526 - DNA, 228 bp, Homo sapiens
ataaaaagaggtagcactgtagactgatgtcctgtaacagaggtacacgtgtgctgttagagccaagagggggtcaaaataaaaagacagggcacggtggctcatacctgtgatcccagcactttaggaggctgaggtgggaggatcacttgaggccaggagttcaagaccagcctgggcaacatagatccccatctctacaaaaaaaaaaaaaaaaaaaaaaaaaaa

SEQ ID NO: 45527 - DNA, 316 bp, Homo sapiens
gaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattg

SEQ ID NO: 45528 - DNA, 231 bp, Homo sapiens
gggcacattgcttgagcccaggcgttcacgaccagccaggacaacacggtgaaaccctgtctctgtaaaaaatacaaaaattagctgggcatggtggtacacacttatagtcgcagctacatgggaggctgagatgggaggatcacttgaacccaggaggcagaggttgcagtgagccatgattgtgccactgcattccagcctgggcgatagagtgagacttttctccaa

SEQ ID NO: 45529 - DNA, 445 bp, Homo sapiens
cagttatttatttccaaaatgtttggaaacagtataatttgacaaagaaaaatgatacttctctttttttgctgttccaccaaatacaattcaaatgctttttgttttatttttttaccaattccaatttcaaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataacaactataaatttcattgattaatctcctggaagattggttaaaaagaaaagtgtaatgc

SEQ ID NO: 45530 - DNA, 604 bp, Homo sapiens
attgaaatgaaattgaaagatgagatgaaatgatgagatgaaatgaaatgttgaaatgatgaagagatgtgacatgaaatgagctgaaatgagatgaaatgaaatgagattaaatgatgagatgaaaaatgatgagatgaaaaatgatgagatgaaatgatgagatgagatgagatgaattgagatgagatgagatgacctaatgccttaggtgaaataatgaactcagatgaaataacgaaataaaattgaaatgagatgagaggaaatgagatgaaatgttgaaaagaaaggaggaaatgatgaggtgagatgaaatgatgagatgaaattgagatgaaatgagatgaaaaatgatacgaaaaatgatataaaaaatatgacatgagatgaaatgagatgaaaaatgatacgaaaaatgatataaaaaatatgacatgaaatgaaatgagatgatatgaaatgacataatgaaataaatgaaattacatgaaatgaaatagtgaaatgaaatgatgaaataatgaaaatgaaatgggaattgagatgagatgagatttgctgaaatgatgagatgaaatgatgagatgatatgaaatgatga

SEQ ID NO: 45531 - DNA, 344 bp, Homo sapiens
aaagcatcacgatgaccttgaataaaaattgcacatactcagtgcagcaagatattaccacgcaagaataaaaaagaaatccatatcttaaagaaacagctttcaagtgcctttctgcagtttttcaggagcgcaaggatggatttgggatacggaataagctcggagttctttacaagggacactccgacaagatttagaaaaaagtttataacataatctactttacagaaaaattttgtgctacaatactttttaaaaggtattttgaatactattaacactgctttttttttccagcaagtgtccaaccaacttggttctgcttcaataaatctttgggg

SEQ ID NO: 45532 - DNA, 225 bp, Homo sapiens
gagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaacccacgtttctttgttgacctgtgtcttgaaggcaaaaaaaaaaaaatttcaacagtagcctttctggtttcaagtt

SEQ ID NO: 45533 - DNA, 141 bp, Homo sapiens
  misc_feature 92: n = A,T,C or G
aacctgaccgtgggcggggccttgcggtatccgaccccaataaaagcaattccaaccttaaaaaaaaaaaaaaaaaaaaaaaaaaaaaaaanaaaaaaaaaaaaaaaaaaaaaaaaaaaaaaaaaaaaaaaaaaaaaaaaa

SEQ ID NO: 45534 - DNA, 580 bp, Homo sapiens
gaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtactttcg

SEQ ID NO: 45535 - DNA, 328 bp, Homo sapiens
atattcagtaaagtctttagacatgaatgtacatgtcattatccaagttacctaattatatcataccatgtaacttttaaatggacacatcgcagatgtcacaataagggaaattatagtatgatagagaggtaaacattttacttacagaaaacctgaactttaattttaagaggttctcagagggactctgtctttgtagaagttcgatagaaacaatcttagttaattttaggccagcctcagggaatgctctcactgaactgacctggtaacttgcctgtgtctactatactctttcttgtattgtggaaaaaaaaaaaaaaaa

SEQ ID NO: 45536 - DNA, 561 bp, Homo sapiens
gagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtacgtgtggttttctttttatttaacccgcagccgacatcgtagtttcttgttttgttttgttttacagagctgttgcatgacttatgttaccacctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagta

SEQ ID NO: 45537 - DNA, 286 bp, Homo sapiens
gatcaaaaggctttgtacatttctatatgagtgggtttactgggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatg

SEQ ID NO: 45538 - DNA, 552 bp, Homo sapiens
agaaacacagattgtattctatgagtcccagaagatgaaaaaaattttatacgttgacaaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcataagagaatgtgttgaaatttaactttgtaaggcttgtatgtgggtggtgatcctttttttccttacagacaccataataaaatatcatattaaaattca

SEQ ID NO: 45539 - DNA, 540 bp, Homo sapiens
gaatactttgactgttgtgtaacagttagccactgctggtgtttatgtgaacattcctatcatatccaaattccctctggagtttcatgttatgcctgttgcaggcacatgtaaagtctagaaaataatgcaaatgtcacggctactctatatacttttgcttggttcattttttttcccttttagttaagcatgactttagatgggaagcctgtgtatcgtggagaaacatagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaaggtggaaaaagagaatatttttggcattcctctaatgttgtgtgttttttttgtgtgtgctggagggaggggatttaattttaattttaaaatgtttaggaaatttatacaaagaaactttttaataaagtatattgaaagttt

SEQ ID NO: 45540 - DNA, 431 bp, Homo sapiens
tactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 45541 - DNA, 622 bp, Homo sapiens
aactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtatttttaaaaaatttgatttagcattcatattttccatcttattcccaattaaaagtatgcagattatttgcccaaatcttcttcagattcagcaattgttcttgccagtctcaattcatc

SEQ ID NO: 45542 - DNA, 241 bp, Homo sapiens
aactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagtcaaaaaaaaaaaaaaaaaaaaaaaaaaaaa

SEQ ID NO: 45543 - DNA, 558 bp, Homo sapiens
gactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttgggtgtcagtgctaatcacgagttgtacattgctcagatttaggtttgacctcagtcccaaccaacattccatttgataccccaatgcttgatcctca

SEQ ID NO: 45544 - DNA, 330 bp, Homo sapiens
aaattctttcaatgtgtcatccctggttgagctggatctgtcctataacaagcttaaaaacataccaactgtcaatgaagaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtacgaatgtctacgtgttgctaacgaagtcactcttaattaatatctgtatcctggaacaatattttatggttatgtttttctgtgtgtcagttttca

SEQ ID NO: 45545 - DNA, 515 bp, Homo sapiens
gaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgcccctggtcttgctttcatcactctaggatcatgaagtgctatgctatttcctgg

SEQ ID NO: 45546 - DNA, 262 bp, Homo sapiens
ggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcgacaaaaaaaaaaaaaaaaaaaaaaaaaaa

SEQ ID NO: 45547 - DNA, 197 bp, Homo sapiens
gttcaataacccaaacatcaaagggacttgtggctgtggagaaagctttaatatttggaatctcaggactcttctggccgtaggttccaggaaagctcgtggaagctttggggctcactgcagaaatcatgtgactgtcacgtgctggaaaataaagtgatacatcttgaaaaaaaaaaaaaaaaaaaaaaaaaaaa

SEQ ID NO: 45548 - DNA, 470 bp, Homo sapiens
gccccgaaggaatagaactctaatctttaactctgtcagaggccttctaaatgttgcattgaaaagttaggtttaaatggcttcattaatcatggcacattccctcaggtccataaataactgcatttgcttcctctggagttaaatgttttctttattcaccttcctttcattctcttctgaatcttgaacttgagaactctcacaaaattgtccctaatattattttgtgttatacgcttaaccatgagccctcattttctcatctgtgagtataattgagagaatagcctatttgtgagggcatcattgtaggaggaacaccgttttgtacatttttttacattatctagaatcctagagaaatgagatgtttttagaaagccaaattttatccctttaagccccagactgaaaaccaactacacattaactatcttatttagaaacatttcaaaatagtcttacca

SEQ ID NO: 45549 - DNA, 445 bp, Homo sapiens
gtttgtagtgctatccattcctctcctgagattttaacttactactggaaatccttaaccaattataatagctttttttctttattttcaaaatgatttcctttgctttgattagacactatgtgcttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaatttt

SEQ ID NO: 45550 - DNA, 537 bp, Homo sapiens
agaatacgttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacaggctatcatctaatctggttacatattgtatttttcatcctgaataaaagtaatttta

SEQ ID NO: 45551 - DNA, 117 bp, Homo sapiens
ggtgtattttttcttttagaatgtaagctcctcaagagcagggacaatgttttctgtatgttctattgtgcctagtacactgtaaatgctcaataaatattgatgatgggaaaaaaa

SEQ ID NO: 45552 - DNA, 521 bp, Homo sapiens
atcattggccagacccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtctcacaaacccttgcaacattgcctgaagttt

SEQ ID NO: 45553 - DNA, 580 bp, Homo sapiens
gttcaaaggattgagaaccaggagctctggtgtctgagggcagtagaagatggatgttccagctcaagaagggaaagtaagaatccgtccttcctccacttttttgttcgattcagatgagccctcaatggactgaacgatgctcacccacactgtgagggctggtcttctttattcaatccactgacttaagtgctgatctcttctggaaacaccttcacagacacacccagaaataatgttctaccagccatgggcctgttacttagcccagtcaagttgacacagaaaattagctatcacaacatctgtgtgtgtatatacatatgtatttgcatgtgtgtgtatatatgtgtatatatattcatgtgtgtgtatatgtgtgtatgttgtgactgggtgtatacacatccatatacataaaatatttcaatatattatattttgtatatatgttatatatgttatatattatatagtaatataaaatatatttatataagacatttttataatctatattgttatacattaggtaaatatatgtatatataaattatatacctacaaatatgttata

SEQ ID NO: 45554 - DNA, 526 bp, Homo sapiens
ataatcttgtgctgctgatttgtttcttgtaaatattaaaacgactccccaattattttgcggaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttt

SEQ ID NO: 45555 - DNA, 463 bp, Homo sapiens
tgattgtataaatgcaataagaaaatgtaaaggtttttgtctattaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgcacccaggctggagtgcggtgcgcaatctcggctcactgcatcctctgcctccgggttcaagcaattctcctgcctcagcttccaagtagctgggattacaggcacgtgccaccacgcccagctaatttttgtatttttagtagagatggggttcaccatattggcacgcacgttggtcttgaactcctgaccttgtgatccaccccgcttggcctcccaaagtgctgggattacaggtgtgaaccaccggcccggccaagtaaaaag

SEQ ID NO: 45556 - DNA, 621 bp, Homo sapiens
agatatccgcttatgaggaacgatatactaccgtaactttctgctggctgaagctaatttattgacttggcaagggcttattgttcctgacaaccctccatatgataagggagccttcagaatcgaaatcaactttccagcagagtacccattcaaaccaccgaagatcacatttaaaacatagatctatcacccaaacatcgcgaaaaggggcaggtctgtctgccagtaattagtgccgaaaactggaagccagcaaccaaaaccgaccaagtaatccagtccctcatagcactggtgaatgacccccagcctgagcacccgcttcgggctgcctagctgaagaatactctaaggaccgtaaaaaattctgtaagaatgctgaagagttacaaagaaatatggggaaaagcgacctgtggactaaaatctgcccgattggttccagcaagtgtgagcagagaccccgtgcagtgcattcagacaccccgcaaagcaggactctgtggaaattgacacgtgccacccgcctgggcggttcgcttgggggaagttactaacctttctaccggtttcttaaatcaaaaagggggcctaagggtaaccccggtaaaggaaagg

SEQ ID NO: 45557 - DNA, 667 bp, Homo sapiens
tatctcaagaagaaaaagaatgcagcattctatgaaatgggtggttcattgtgatctagtgagatttattctgagaatgcaaggctggttaagtattcaaaatttcaatcagtgtcattcactatattaatagaatgaaggagaataaaaaccatgatcatagcaatagatgtataatgagcctctgacaaaatgcatcacacatttatgatacaaaacacttaggagactggaaatagaagcccacttgctaacaggcctctgtgctcaacagtatgcttaatggtgaatgctttcctcctaaggccggtaagaaggcaaggatgttcatattcattacttctatttcatattgtgctgaatagtctagttagtgccataaggaacaaaaaatgtgcccagattggaaaggaagaaataaaactcgttattcacagaaaacattactatgcatgtagaaaatctaaggaatttacaaaaagtagagtaatttagcaaggtagtagggatccatgattaatatacaaaagtcaaacctatgtctatatattatcaatgggcatttggaaaataaagttaagaataccatatcatttataaaaccaaaaattatatccttggggataaattaagaaaagatgtgccagaattggccatggaaattccc

SEQ ID NO: 45558 - DNA, 521 bp, Homo sapiens
gtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttcgggtcatcccaggttctgacttttacaggggcaaaaaaaaaaa

SEQ ID NO: 45559 - DNA, 373 bp, Homo sapiens
aacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtagaa

SEQ ID NO: 45560 - DNA, 511 bp, Homo sapiens
gtacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatggatatcactggt

SEQ ID NO: 45561 - DNA, 469 bp, Homo sapiens
ggggaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttaagacggagtttcgctcttgttgcccgggctggagtgcggtggcacgatctcggctcaccgcagcctccgcctcccgggttcaagcgattctcctgcctcagcctcccgagtagctgggattacaggcatgtaccaccacgcccgggtagttttgtatttttagtagagacggggggtttctccgtgttggtcaggctggtctggaactccagacctcaggtgatacccctgcctcggcctcccaatgtgctgggattgcggctgtgaagccaccgcgcccggctgctgtgatagttgagatgtaaacca

SEQ ID NO: 45562 - DNA, 293 bp, Homo sapiens
agacttcctcctggaaaacgctttggtagatttggccaggagctttcttttatgtaaattggataaatacacacaccatacactatccacagatatagccaagtagatttgggtagaggatactatttccagagtagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttg

SEQ ID NO: 45563 - DNA, 551 bp, Homo sapiens
gagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattaagacaaacagt

SEQ ID NO: 45564 - DNA, 496 bp, Homo sapiens
aaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagcttactactgtgggaagacaactgttttaataaaagattacattccaca

SEQ ID NO: 45565 - DNA, 392 bp, Homo sapiens
ggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccgacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagtttca

SEQ ID NO: 45566 - DNA, 195 bp, Homo sapiens
atctggggaaaagtaactcgggcccatggaaacagtggcatggttcgtgccaaattccgaagcaatcttcctgctaaggccattgtgacacagaatccgagtgatgctgtacccctcaaggatttaaactaacgaaaaatcaataaataaatgtggatttgtgctcttgaaaaaaaaaaaaaaaaaaaaaaaaaa

SEQ ID NO: 45567 - DNA, 354 bp, Homo sapiens
ctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccacc

SEQ ID NO: 45568 - DNA, 665 bp, Homo sapiens
ggagtaagcatgcagttgctgtcatttgggcttactggcttggactgaaggtacgtagagaatacaggaaattcttcagagccaatgctggaaagaaaatctatgagtttacgcttcagagaattgtgcaaagatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccctcttgctgacaaaagtctggacaaatcaagtcagaggttcactggtggatgtgacaaggtatcaatgagctcacaaaatgatggctctcgcgtcactcaaagagggctcagagcagctagtaaa

SEQ ID NO: 45569 - DNA, 501 bp, Homo sapiens
gtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactccaagtca

SEQ ID NO: 45570 - DNA, 145 bp, Homo sapiens
gcgctgtgtacaatgtgagatcggtgcgttctcctgatgttttgccgtggcttggggattgtacacgggaccagctcacgtaatgcattgcctgtaacaatgtaataaaaagcctctttcttttaaaaaaaaaaaaaaaaaaaaa

SEQ ID NO: 45571 - DNA, 204 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaa

SEQ ID NO: 45572 - DNA, 536 bp, Homo sapiens
atttgatatttattcaacattcatagagccccccacaatattggatacggaaatgaagaggttggatcaagaacaaggccctgaggagtctcagccagaaactgacacctcagacatggatcctttagttggtttcaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaggtaattagaaaagtattggtcccaattttgctatctcccatcccataacagcctctgaatttatgcacaagtgtatgagaacattttgtatacaagagtttggaaaattatatataaaaatacaa

SEQ ID NO: 45573 - DNA, 500 bp, Homo sapiens
gagttctgcttgctgtccgcaccgctgcgtgacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttatta

SEQ ID NO: 45574 - DNA, 339 bp, Homo sapiens
atgtatcaggcatcaaattgaaccaccagcactgctaccaggaatctaaaatgcaggagtacatgcacatttgcatatatgcccacatatatatttgtacacacatgtacatgtgcacacactcacacacaatgggatagctaaattcgaaactcttctatttagccagtacacttgaagagggttaaaatagtcctaggtaaatcatgcctactggcttccagaaaaaaataaacaaattttcttctggaggaaagcatccctaaattaggctctctggattcctatacattcagttcaacaaaatatgagcttattaaaaagatttaccaaacatac

SEQ ID NO: 45575 - DNA, 577 bp, Homo sapiens
ggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaccgttattgtgcaaacccaagaacgtcagatcccaaagcacaacaacctggatggactttgggaacatctaagcaatgtaagagagaggtgcactgagagtacgtcttggtcccctccaccctgagagcatctggcggtcctcagtactgaactcccggaagctgctctgagcccggtgacctcatctgggccaggtgtggtgcctgagctgaatgctcaggtgcttacagtgttgcaatccctaa

SEQ ID NO: 45576 - DNA, 510 bp, Homo sapiens
agggacatgaatggagctggaaggcattttcctcagcaaactaatgtataaacagaaaaacaaacaccacatgttcccacttataagtgggagctgaacaatgagaacacctggacacgaggggaacaacatacactggagcttgttggggagggcgaggcaagagattgagggggattgggatagcagtacgaaaaatagtgcatgctggggttaatacctaggtgatggattgataggtgcggcaaaccattcactgtggcacatgttttcctatgtaacaaaccttcacatcctgcacaggtaccccagaactttaaacaaaaaacaatagtgttaatatgaaaatatatttcctccatagtttagcatatgatttaagcatagtacatacctaatatttacttattaacaggatatatactatgtatatttactctgtggtatagtatactacttgtaaaacagataacagcatcaaaacagtgaaatctccctagagacttttca

SEQ ID NO: 45577 - DNA, 540 bp, Homo sapiens
tgtgattccaaatttccgcatgcacagtgcacagtcagagcacctgggtgaaacaattggttcatgtaacaaagctgaggtctttggtgaatatgaatcacacttggctagagagttggtaatttgtgttgcataaaaagcctagtagcagtgattccctgggccacagtacacgtgcattaaccacgtgtctggaaagggactgtttgcccgtatcaacatgattgtggaccctgactgcactacagtggtttatctatgactccgtgaaggtctacgtcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcctgcttaaggcaagagtttcagatttactgttgaaataaacccaactcttcatgaaaaaaaaaaa

SEQ ID NO: 45578 - DNA, 398 bp, Homo sapiens
gaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttttgttcaaatgattttaattattggaatgcacaatttttttaatatgcaaat

SEQ ID NO: 45579 - DNA, 458 bp, Homo sapiens
gagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagccaggctgctatggagggactcaatggccaggatttgatgggacagcccatca

SEQ ID NO: 45580 - DNA, 660 bp, Homo sapiens
gactaaaagtattggagaaagaaattcgtacatctaggagctatagaactagtaccgcaagggaaagatgaaagactaattaaaagtaagaacaagcaaagattaaaccttgtaccttttgcataatgaactaactagaaaacttctaactaaaagaattacagctagaaaccccgaaaccaaacgagctacctaaaaacaattttatgaatcaactcgtctatgtggcaaaatagtgagaagatttttaggtagaggtgaaaagcctaacgagcttggtgatagctggttacccaaaaaatgaatttaagttcaattttaaacttgctaaaaaaacaacaaaatcaaaaagtaagtttagattatagccaaaagagggacagctcttctggaacggaaaaaacctttaatagtgaataattaacaaaacagcttttaaccattgtaggcctaaaagcagccaccaataaagaaagcgttcaagctcaacataaaatttcaattaattccataatttacaccaacttcctaaacttaaaattgggttaatctataactttatagatgcaacactgttagtatgagtaacaagaattccaattctcaggcatacgcgtataacaactcggataaccattgttagttaatcagactataggg

SEQ ID NO: 45581 - DNA, 549 bp, Homo sapiens
ggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctccggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattccaagatttggtttgggatcaatagggaagcata

SEQ ID NO: 45582 - DNA, 348 bp, Homo sapiens
tttctcccaagggcgaaagtcattggaatttttaaatcataggggaagagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgt

SEQ ID NO: 45583 - DNA, 513 bp, Homo sapiens
gccccccaagctgatggggtcaaatgaaggtgaattcaaggctgaaggaaatagcaaattcacctacacagttctggaggatgggtgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgcaaccagtgcaagtgaccgacaaaattccagttatttatttccaaaatgtttggaaacagtataatttgcaaagaaaaatgatcttctctttttttgctggtccccaaatacaattcaaatgcttttggtttatttttttaccaattccaattcaaaatggctcaatggtgctataataaataaacctcaacactctttatgagaa

SEQ ID NO: 45584 - DNA, 485 bp, Homo sapiens
cccaagatatgtttagagaagtggatgaaatagatgagataaggagattcagaaacaaacttatagtgatgcgttggaagggaatcgaaaccatccttacccctatttaatgtagtttaccttgatttttatctgatattaacaataccatatagcttgctttttattagcatttcctgatattccttggccatatttctacttataacctgttgctattaatgggtttagatgtatctcttgttatctgcatctcattggttattggattttgaaccaatctacaaggctctggcttttaataaaagaactttacacatttgtaaaaaagaggtcctgggaagatataaaatggaaaaaggctaaggaatatgggaatatcatatttttggaaaggtaaaaaggacatttggatattacatatatggacataacctgtgaaggatgaaagaaagtacagcccctcggtggtgggatatgaatga

SEQ ID NO: 45585 - DNA, 221 bp, Homo sapiens
tcgaatgatactgagaagcctgtaaagaggagaaaaaaacataatctgtgtttccccataagtttttttaaattgtatattgtatttgtagtaatattccaaaagaatgtaaataggaaatagagtgatgcttatgttaagtcctaacactacagtagaagaatggaagcagtgcaaataaattacatttttcccaaaaaaaaaaaaaaaaaaaaaaaaaa

SEQ ID NO: 45586 - DNA, 450 bp, Homo sapiens
ccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccc

SEQ ID NO: 45587 - DNA, 682 bp, Homo sapiens
ttcttttacaatcttgatttttaacttacagcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtgccagtttactgatgagtatctcccagaacaacgatctcacctctacgggataactgcagtctacccctactgccaacaggaagaaagtagtacagtaatgtaaaggaagacttggagttacaatcagaacctggccctaaagacagtgctgcaaggcaaagaaagtaaaaaggaattggcattagacgtcctgagatccagatgacatttgagtgaaaaagactttgtgaaaagctgaacctaatcttactactgattttaaaaaagaaggtggtattgcaggttaaaaaggaacagaattttaccggtggttataaagcacctcttggaaccttttt

SEQ ID NO: 45588 - DNA, 238 bp, Homo sapiens
ttatgaataaaaataaaagacatgtttttagttattgtatgttactctgagctacacattatttaacatctctgaaactggaatatattatacaattgatagactcattttaattagcaggttattgttttcttagcagtacataagaaatggtgaatcttattgattcagtggcatttagattctattaaatataatttttaactgaagttgtacatagttaaataaaagtttacta

SEQ ID NO: 45589 - DNA, 528 bp, Homo sapiens
gtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggcaactgttggttgagatagttggttcttttaccccacgaagacatcaaagatacacttgtaaataaagctggatagcatat

SEQ ID NO: 45590 - DNA, 304 bp, Homo sapiens
ggctattggactctctgtaccagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaagtg

SEQ ID NO: 45591 - DNA, 414 bp, Homo sapiens
gacttgaaacaagacaagaatgcccacttttaccacttacattaaacacagtactggaagttctaggcagagccattaggcaagagagagaaataatggacatccaaatctgaaaggaggaagccaaattgtccctggttgcagatgacatggtcatatttatagaaaactccaaagattgcaccaaaaaactgttagaactaataaataaatttagtaaatttacagaatacaaatcaacatataaaaattagtagtatttctataaaccaatagcaaactctctgaaaaagaaatcaagaaagcaatttcatttgcaatagctaaagaaaaaaacctaggaataaacttaactgaggagatgaaagatccctatagtaaaaactataaaacatggatgaaagaaattgaaaa

SEQ ID NO: 45592 - DNA, 390 bp, Homo sapiens
acgggaattcggccattatggccgggaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagtaaaaaaaaaaaaaaaaaaa

SEQ ID NO: 45593 - DNA, 453 bp, Homo sapiens
gatggctgttcgagagaaatcggaataaaagcctaaacaggaacaacttcatcacagtgttgatgttggacacatagatggtgatggcacaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactg

SEQ ID NO: 45594 - DNA, 102 bp, Homo sapiens
agggttcgattccggagagggagcctgagaaacggctaccacatccaaggaaggcagcaggcgcgcaaattacccactcccgacccggggaggtagtgacaa

SEQ ID NO: 45595 - DNA, 477 bp, Homo sapiens
ggtcatcggagctgtggtcgctgctgtgatgtgtaggaggaagagttcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtgggggctggatgtctccatctctgtctcaactttacgtgcactgagctgcaacttcttacttccctactgaaaataagaatctgaatataaaatttgttttctcaaatatttgc

SEQ ID NO: 45596 - DNA, 664 bp, Homo sapiens
gtagtcatcaacaacaaaagaatatctgaagggtcaggtcatccatataatatatttggaaaaatatttcatgactgcacagacctagatacttcaaaacaaagactgtgtaagtgtgattcatttgaaaagaccttgaaaccaaatattaacctagtgagttataataggaattttgcaagaaaaaacattgatgagaattttagatgtgggaaaacacctagctacagttcttgctattctaagcatgaaaaaaatcatagtggaatgatacactgtgaagctactcattgtggaaagattcttagcaataaacaatctcttattcattatgtgaatgttgaaactggggagaagacctatgtatgtgttgaatgtggaaaatcctttctcaagaagtcacagattattatacatcaaagaattcatactggagagaaaccttatgattgtggtgcatgtggaaaagccttcagtgagaagtcacaccttactgcacatcagagaactcatactggggagaaaccttatgattgttctgaatgtggaaaaggcttttcccagaaatcatccctcattatacatcagagagttcacactgggggaaaaccatatgaatggtagtgaatgtgagaaagccttctcccagaaatcacccctcatt

SEQ ID NO: 45597 - DNA, 383 bp, Homo sapiens
gtgatgtcacgggtagggacagcacagttagccctggtggctcgagcccataatgtaccagtgctggtttgctgtgaaaaatacaatttctgtgaagctgttgaaaactgaagccattgtcctcaaagacctaacagaacctgatgaatcctgcaatgttagcggggaaaacatgttgcgctgggcaactggcaagaaccacgcatccctacggttgttgaatctaatccatgatgtgactcccccaaagcttgtggatccggtgatcacgggcctggggatgatcccctgcaattctgtacctgttgttctacgagtcaagagcaatggccagtgacggggaaacacaagggtaataaatgccatactccctaacctcagca

SEQ ID NO: 45598 - DNA, 648 bp, Homo sapiens
taacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggcctctttctggtcacaagctctctgggctccagtttgtcctgcaagatggagcacacacatggttgattctaatgaaatctctttcatccgagcaggagaaggtgctcttaaacaagccttgggcaaatgcaacattatgtatctgactatatggctgtggagtgtagctcaaatgatttcaggacagtatgcaggataacgacgcatggggtatcactgggcagatgagt

SEQ ID NO: 45599 - DNA, 386 bp, Homo sapiens
cagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaa

SEQ ID NO: 45600 - DNA, 215 bp, Homo sapiens
atattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttataaaaaaaaaaaaaaaaaaaaaaaaaaaaaaa

SEQ ID NO: 45601 - DNA, 347 bp, Homo sapiens
attgcattcatggttgaaactcaacttagggaaagggttccaatgtattaagcaatgggctgcttctccccaatcctccctaacaatttgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaacactgttgacaataaaaaaaaaaaaaaaa

SEQ ID NO: 45602 - DNA, 416 bp, Homo sapiens
gaaactgtcatcagggtgaacagacaacctacagaatgggggaaaacttttgcaatctatccatctgacaaagatttaatatccagagtctacaagggacttaaacaaatttacaagaataaaacaatcaaccccattaaaaagtgggtaaaaggcatgaacagacacttctcaaaagaagacattcatgtggccataaacatatgaaaaaaagctcaatatcactgatcattagataaatgcaaatcaaaaccacaatgagataccatcagtcataatggtgattgttaaaaagtcaagaaggccatgttggagtgtaaactagttcacccattgtgggagacagtgtggcgattcctcaaagacctagagggcagaattatcatttgacccagcagtctcatactgggtatata

SEQ ID NO: 45603 - DNA, 542 bp, Homo sapiens
gagtatcacccaggctgcagccacaccaggactgtgttgacgggtgttttttttcttttaaatgtaataccgcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgacggatatggaagacacagatgatgatgatgatgatgatgatgatgatgatggtgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgctgatctcaaaacaactaaag

SEQ ID NO: 45604 - DNA, 398 bp, Homo sapiens
tttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactacgatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctaaaaaaaaaaaaa

SEQ ID NO: 45605 - DNA, 404 bp, Homo sapiens
gagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaatt

SEQ ID NO: 45606 - DNA, 223 bp, Homo sapiens
ctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtg

SEQ ID NO: 45607 - DNA, 512 bp, Homo sapiens
ggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataaggggttgagagaaacaagcatctattgcagtttccttttgcgtacaaatgatcttacataaatctcatgc

SEQ ID NO: 45608 - DNA, 346 bp, Homo sapiens
atacaacataaacctaaactataaaacagcaatggttccaggtaatgttggccgtgacatttaaagaacaaaattgcttatgaagttgagatggttaccaaattgtaaattcctaactcagggctttgaaaaatcaattgtaggaaagaatctttgacaatttggctacagaaaaaaggaatgattcttttaaaattgtatgcagatggattcactgaaatgcaaaggttgtaataaaacaatttttaaatgttggatcaacagatagtgtaacaaagcaccttgaaacagtattcaccaaataataaaaagctcaactttttattgataaataaaattcgatcta

SEQ ID NO: 45609 - DNA, 298 bp, Homo sapiens
agatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgaaaaaaaaaaaaaaaaa

SEQ ID NO: 45610 - DNA, 380 bp, Homo sapiens
gaatttcccagcatctctgctgtagacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttggtaatgtcattgcc

SEQ ID NO: 45611 - DNA, 275 bp, Homo sapiens
aatccacactatatatgtgtgtatatgatatcatatatgtatgcctcattctaaccattgacgtctcagactgggaatgcctttgacgacagatgcttccatagagggctctttgacctatatagttcagcgtttgtctatttatgctggtatccactcagaaccctaatcatagcccgcaagaaggaatgttactttcatattggctctgctcatgtgcacgtgaccgcatcctgtttttcccgacatatgaggccgagagggcattttctagt

SEQ ID NO: 45612 - DNA, 135 bp, Homo sapiens
taatgacttctggatcctgagctccctttgcagtctgaaaaaggtatggcaggcagaactgtgcactgatgataaaagcctctggtagcaataaaaagttgtccttaaaaaaaaaaaaaaaaaaaaaaaaaaaaa

SEQ ID NO: 45613 - DNA, 635 bp, Homo sapiens
ggaagctgtagtgagaaactgtagctttgaaatgtagtgatctttatccactgttgggcttgggtcaaagaccttggacaaggaaggaaaaaagggaaggagatacattatagaaaccagatgttaaaaactgataaaggctgaccagccccctgctgctaaaatctaaccccacctccatcaaaaaggtgacattctcctctgaagcccctctgtccttctaggagaaaaagcgacacaattctggctctgcatttttcctttggcctaccttgcgaatggccctagaagactaaacaggtgttatctacttttgatttcagtgcatttaaattaatcctgcagctcagctggtaaaacaactgcatctccagctggtagtaattttcgactgggcactttcacaggttgccaagatctgagcctgcattgtgggtctctctgaatgcactagagaacaatttgtggcttttaaaggggactgggattgtgatgctgacacatgaaatgacataataataattcaaaatcagcctggggccatgtttgaaaatataaataaccggggctgatgcccacttattatatctggcgggggtacataacttttgggggactaaatcaaagaacaataa

SEQ ID NO: 45614 - DNA, 413 bp, Homo sapiens
gggggaaggaacaaaggaggataatttttattgcattttactgttcatcacaaggccatttttatatacggacacttttaataagctatttcaatttgtttgttatattaagttgactttatcaaatacacaaagattttttttgcatatgtttccttcgtttaaaaccagtttcataattggttgtatatgtagacttggagttttatctttttacttgttgccatggaactgaaaccattagaggtttttgtcttgcttggggttttgtttcttggtttgggttttttatatatatatataaaagaacaaaatgaaaaaaaacacccacacacaagagtttacagattaagtttaaattgataatgaaatgtgaagtttggcctagtttacatcttagagagggggagtat

SEQ ID NO: 45615 - DNA, 388 bp, Homo sapiens
ggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcaa

SEQ ID NO: 45616 - DNA, 386 bp, Homo sapiens
aaggtcatgaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcggaaaaacttaaatattatggcaaaaaaacatt

SEQ ID NO: 45617 - DNA, 456 bp, Homo sapiens
gagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgcca

SEQ ID NO: 45618 - DNA, 563 bp, Homo sapiens
atagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgttctctttgattatttgcatgttatgtttaataagctactagcaaaataaaacatagtaaatgacaag

SEQ ID NO: 45619 - DNA, 341 bp, Homo sapiens
gacaagaggcagttccatttcatttgtgtcagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaaaaaaaaaaaaaaaaaaaaaa

SEQ ID NO: 45620 - DNA, 644 bp, Homo sapiens
atgttgactgttttcaagtttcagaaaagatattttcatatgataggattgagtatcatgggtatagtttgatcttgacatatagtttgaaaatcatactcaaaagatttgcattcatgaaaccagtgaacaatagggtggaatggatgaaccatctccttggaagacagagcccaattttcaattttttctttggctatcaagttgctagtcacttattcaggattttcatccaaactgtgtttggactgactgtataagtcttactgccttttcagaaatctgctttcctttgtgtgatttttcttgtactgtacagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgcaaaatgcattttcaaatttttaaaaattcctcaagatgatatatttgaaatgtctaaaataagcggtgcttgaaacattagtgca

SEQ ID NO: 45621 - DNA, 708 bp, Homo sapiens
gttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaatacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaaatctttgtgccctcgctgcagttccctttgggttccaagtttttccttgttccctcccaagcctagctggattg

SEQ ID NO: 45622 - DNA, 450 bp, Homo sapiens
gggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatggggttttttttttttaa

SEQ ID NO: 45623 - DNA, 710 bp, Homo sapiens
gtagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaaagtgtcaaggccttgatattgcccctttgggtaacactaagcttaagtagacatacagttgtatgaatttgtaaagtatatgaacacc

SEQ ID NO: 45624 - DNA, 555 bp, Homo sapiens
gataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcctt

SEQ ID NO: 45625 - DNA, 595 bp, Homo sapiens
aataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggactggcggtgcttcatatccctctagaggagcctgttctgtaatcgataaaccccgataccaaaaaaaaaaa

SEQ ID NO: 45626 - DNA, 551 bp, Homo sapiens
taaatatgaacattcatccaattgaatttacaaaatctttccaaaattataagggagaaaaatcgggtttacttccatctttaaaaatctggcacctcttagtaactttcagtatttctaaattgctctaaaattttataataaatagattagggttttgcaatagtcttaatttttaagccaaaggttttctgagaccttaggttttgtagtctaaccagcttgtgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttctaaaaaa

SEQ ID NO: 45627 - DNA, 540 bp, Homo sapiens
gtgattattagctattggtataaacaggtagaagtgtacactatgtttcttcattggtcattcaaatgggatgaatatagtttttgaatttttaagatggtattttaaagggaggaatcacattaggatcacaatcacgacatatttttactccctgtatccagtgtagtgaaattgtttggagcatttgagatcctaaagcttcactatttactcagtgtattggtatgtgagtaaatctgcagaaaataagactccttagttattatagcttccttatgcaaatagcatattcaacaaaggatgttaagggaaaaatttatggttctccttggatacatttgatttgatgggtttttttgccgcattattctagttttttaagcttctgaacattttcatactatatcagagaatggtgtaaactctaaatggtataagcttcatccatttataatgacactaacctaaaaaaaaatagactggtagtgacaagatttattgcatatgtgtttattatacattaccccaataccatta

SEQ ID NO: 45628 - DNA, 492 bp, Homo sapiens
gatctgctttaagaattaacgacagcagtgtcatgacagtgaggattcaaaccatttgccaaaaatgagtctaagtgcatttactcacttcctggcattgaatggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggctttgagaatgtaactgatctgcagtggctcattctagatcacaaccttctagaaaactccaagataaaagggagagttttctctaaattgaaacaactgaagaagctgcatataaaccacaacaacctgacagagtctgtggggccacttccaaatctctggaggatctgcagc

SEQ ID NO: 45629 - DNA, 426 bp, Homo sapiens
aattcggccattatggccggggcatacaaaaaacttaaattgatattcctgctgaggcaggaggatcacttcagcctaggagttcaagatcagccgaagcaatatagtgagatctcatctctaccaaaacaaaacaaaacaaaaaaacaagtgaaagaagccaatctgaaaaggatacatactgcgtaactcaaagtatatgacactctggaaaaggcaaaactatggggatagtaaaaagattagtggttgtcaggaattgggggaagggagggatgtcaggaattgggggaagggagcgatgaataggcagagcagagtatttttagggcaattaaattattttttacaatgataaacacacgtctttatatcttcgtcaaaacctatcaattagaaccaagtgatcacagcaaaaaaaaaaaa

SEQ ID NO: 45630 - DNA, 603 bp, Homo sapiens
aagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcacatgagaagaacactgttgaaataagggactaaagctttatatattgatcaggtgattctgaaagttt

SEQ ID NO: 45631 - DNA, 489 bp, Homo sapiens
ggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaagctgcggttttagatgctttgttttgatcattt

SEQ ID NO: 45632 - DNA, 291 bp, Homo sapiens
ctctatctgacatcccaacaagaaaaatttaactccatatgtgttcctcttgttctaatcttgtcaaccagtgcaagtgaccgacaaaattccagttatttatttccaaaatgtttggaaacagtataatttgacaaagaaagatgatacttctctttttttgctgttccaccaaatacaattcaaatgctttttgttttatttttttaccaattccaatttcaaaatgtctcaatggtgctataataaataaacttcaacactctttatgataacgaaaaaaaaaaaaaa

SEQ ID NO: 45633 - DNA, 428 bp, Homo sapiens
aactatagaggatttggaatgaaaatagagaaatgccgacagtgcattttagaattttgccttaaattgggcaagaaagctattattttaaattactagaaatgaaaataaagaaagcatagtcccatgaaagcctgtgagtattactgccttgctccattaccaaactctggatatttaaacagtcatttggtcccaagaaatacccacttttatgttaataccactgatagttattagatttaatttagctataagcatttaagtggtggtcaccaggcccatgattatgtgaatctcaccttgttcacaaaatggaactcctgatgtctggacgcgggagtattcagaccgctttccgggctgattcacagagggaaaaacatctgaccacccaaatcctagagtgaagtctcctcactcccaca

SEQ ID NO: 45634 - DNA, 508 bp, Homo sapiens
actgcagtgagggtcaaaggagagtcaacatatgtgattgttccataataaacttctggtgtgatactttcatcttgtaaatctgcttttcttttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgt

SEQ ID NO: 45635 - DNA, 159 bp, Homo sapiens
caagataaattagttgttttcttatttttttggcttagtatattgaaataaactatggtatcttcatcattttgtacatttcctttttgaggaaggtttctttataaatgcaagggctaccctaataaaggaatgtatatacttacagtaagaaaaaaa

SEQ ID NO: 45636 - DNA, 391 bp, Homo sapiens
gaaaccgcagataagtttttttctctttgaaagatagagattaagacaactacttaaaaaatatagtcaataggttactaagatattgcttagcgttaagtttttaacgtaattttaatagcttaagattttaagagaaaatatgaagacttagaagagtaccatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttt

SEQ ID NO: 45637 - DNA, 275 bp, Homo sapiens
atataacacttatcttcttcttaattcggcaatggaatatcttttaagttttaaaaaaactggaataattatatctatcttttttgccgtttatatttaggggtttttgttgactaaaatcaagtcttggttgtggcttgctgaattaaatatttatgagtggtgcatttttaagtatagtgaacaagacaccatattaagtacagtgataaagcatctatattctgtaaaaaaaaaaaaaatcggcctaggcatgttttctaaaaaaaaaaaaa

SEQ ID NO: 45638 - DNA, 670 bp, Homo sapiens
taagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcgaaatgttttttccagttagtcctcctcaaggaattactaatgttccttttgtcacaggtaaaatcagtgttgggaattataatttgagaaaatattacccagtaacattgaatgttgatggctaaacgaaccttacccagtgtgaa

SEQ ID NO: 45639 - DNA, 647 bp, Homo sapiens
attgattggttcgtgacatgatatttagatgcggctccttatacatttttgccatcttatgaaatttgcagtatgtattttttacccttaaataattataatctatggttgctttttggtaaaggtattatttcagccattatatgaatttaatttggaataggtttttttaaacctggaaaaaagcctaccaggcccccgccttttaatggaccaccttaccaccctggggggaaataaaattttggggccaaggggaggccccccttttttttagggtaattaaccaaggccggaaaaggggccaaaaggtttttttttaaagggaatttacccaaggccaaaaaaaggtttcccaagcccttgggtttggggcccttggggggccaacccttggttgggggaaaagggaaagggtttgaaagaaaaaaagggtggggggaacccccctttcttggggggggcccccctggggaataacccagggcccctccttggaaatggccctggtttgggaaaggaaaagggaatggaaaagaaaggggggccctccaagggggccaccccaaaaccccaatttaacctttttttttaacccccctttttttggttcaaaaggcctttggccattggccaaaaaccctctt

SEQ ID NO: 45640 - DNA, 340 bp, Homo sapiens
cgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaaaaaaa

SEQ ID NO: 45641 - DNA, 175 bp, Homo sapiens
gctttaatgccaacccaagacaaccaaccaaaaataatgaattttaaacaaaaatataattattcattatttctacacagcattcaactgcgaccaatgacatgaaaaatcatcgttgtaattcaactacagaaaccctaaaaaaaaaaaaaaaaaaaaaaaaaaaaaaaaaaaa

SEQ ID NO: 45642 - DNA, 750 bp, Homo sapiens
aatgatactggcctcataaaatgaggttaaggaggagtctttcctcctaaatcttttgtaatagtttcagtaggattggtagtagctctttgttatacatctggtagaatttggttgtgaatctctctggtctagggctttttctggttggtagtctttttattactgatttaattttgtaattcgttattggtctgttcagggtttcaatttcagactttaaaccaacaatgatcaaaaaagacaaagaaggcattatataatgataaagggtccaattcaacaagaagacttaactgttctagatatgtatgcacccaatgctggagcactcagattcataaatcaagttttagggcctagtgagagacttagataccatcaataatagtgggagatttcaacatctcactaacattattagatagatcatcgaggcagaaaactaacttaaccatatttggagacctaaacttgacacttgaccaaatggacctaacagacatcttcagaacactggacccaacaaccgacacaatatgccttattttcacctacacgtggacatactttaaaaatgactaccccccttggctataaaacaatttggcaccaaatgaaaaaaaaccctgaaatcatactagccggacctttcagaccccagcacgggtaaaaataaaaatcaatgctaaaaaatttctctcaaaaatccttgggaaattgaaccaacccggctcctgaatgaccttt

SEQ ID NO: 45643 - DNA, 189 bp, Homo sapiens
agttcaactttaaatttgcccacagatccctctaaatccccttgtaaatttaactgttagcccaaagaggaacatgctctttggacactaggaaaaaaccttgtagagagagtaaaaaatttaacacccatagtaggcctaaaagcagccaccaattaagaaagcgttcaagctcaacacccactacct

SEQ ID NO: 45644 - DNA, 442 bp, Homo sapiens
ggatgactaaatacttgacaactactttctgaagactggcttaacaaaaagttactatttgaagaaacagctttcccttgtttatatttacaagaaaaaggctaacatttttgcagaactctcattttatcatgaagtgtggacagtcagaagcaggtggctgttggtggggtgcagtggctcacacctgtaatcccagcactttgggaggccaaggcaggcagatcacttgaggtcaggagttcaagaccagccgggccaacatggtgaaaccctgtctctactaaaaatacaaaaactagctgggtatgatggtgattgcctgtgatcccacctattcggggaggctgaggcatgagaatcacttgaacccgggaggcggaggttccagtgagctgagatcgtgccacctgggtgataggcaagactccctcgcaaaaaa

SEQ ID NO: 45645 - DNA, 390 bp, Homo sapiens
atctacaaaggccatgggaaaaattcagagagttaggaaggaaaaaccaatagctttagaacctgtgtgccattttaagagttacttaatgtttggtaacttttatgccttcactttacaaattcaagccttagataaaagaaccgagcaattttctgctaaaaagaccttgatttagcactatttacatacaggccatactttacaaagtatttgctgaatggggaccttttgaggtgaatttattttattatttttattttggttaatggctggggctttctatcacctcttctaatcttttaatggatttggttgcaatttggggaaagacttttttatgagactttttctgtgaaggtttaagcggcaatttgccttttaatgaac

SEQ ID NO: 45646 - DNA, 603 bp, Homo sapiens
gttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctcccccttcccaacccttctctacttggctgctgttttaaagtttgcccttccccaaatttgggatttttattacagatctaaagctctttcgattttatactgatt

SEQ ID NO: 45647 - DNA, 585 bp, Homo sapiens
atcaatttcgagcagaaggaaagtaatggaccagtgaaggtgtggggaagcattaaaggactgactgaaggcctgcatggattccatgttcatgagtttggagataatacagcaggctgtaccaagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaaagtacctgtagtgagaaactggatttatgatcactttgg

SEQ ID NO: 45648 - DNA, 474 bp, Homo sapiens
aggttaatccactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgtgcgatacagggtgacagccccgtacacaaaaatgcacatattgtgagctcgatgagtagggcgggacacgtggtatcctgtctgaatatggggggaccatcctccaaggctaaacactcctgactgaccgatagtgaaccaagtaccgtgagggaaa

SEQ ID NO: 45649 - DNA, 596 bp, Homo sapiens
aaatacgaaattagaaaagccctccctattttaactacctcaactggtcagaaacacagattgtattctatgagtcccagaagatgaaaaaaattttatacgttgataaaacttagaaatttcattgattaatctcctggaagattggtttaaaaagaaaagtgtaatgcaagaatttaaagaaatatttttaaagccacaattattttaatgttggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgctttgtcacactagcatagagaatgggttgaaatttaactttgtaagcttgtatgtggttgttgatctttttttcctacagacaccataataaaatatcatattaaaattct

SEQ ID NO: 45650 - DNA, 596 bp, Homo sapiens
gctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctggggcaa

SEQ ID NO: 45651 - DNA, 372 bp, Homo sapiens
tgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttgg

SEQ ID NO: 45652 - DNA, 580 bp, Homo sapiens
gagaagtaacattcctttgaacactcagctttctgaaatggtgtcccaccgcaaggactggagaagggtaaacctcaggttctcctcctgccttttgctaagtatatgtcttgatgacaagccttctgctgatgagctgtgtttctggaccgatcatggtagaagtcaattaacgtgtccctcacttggggtttctcaagggagtctcactctgtcgtccgggctggagtgcagtggcgcggtctcggctcgctgcgggctctgcctcccgggttcacgccattctcctgcctcagtctcccaagtagctgcactgatgaggaaactgaaacagaaaatccagagtaaattccaccaggccacacagcaaggtctgatagagccaggagagactttatgaaatccagactctcacactaatgctctatcagctagacctccatgtgagtctccccaatgtaggtaggaagtgcttccctaaaatgctcataaagcaaatcagagcaatgctgcattccatgtgatttctaatttgaaatgcaaacaattgccaatttgtttgacctgtatttaaaaatta

SEQ ID NO: 45653 - DNA, 257 bp, Homo sapiens
ggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttaaaaaaaaaa

SEQ ID NO: 45654 - DNA, 273 bp, Homo sapiens
attgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttcc

SEQ ID NO: 45655 - DNA, 461 bp, Homo sapiens
atcccaattttttgtattcacactccatatggaatattgaaggttttgagaagtcagttctgtagttcagtttaatcttgcatgttttccacatttaattttagatctttgctttgatatatctcttattaaataaattaccaggaagtaatatcgcattgaatacacactggcaaatggggctatataaagctatttattaataaggttgagaatcttgatgaattgtatgatttcataggactacatagaaaggaggaaacataaacagactggactcatgaacaattttttttaaattcaaagaataatctccaaaaatggcaactgtaactatgcaggtattttcaacttttaaagaacagagaatatccactctgaataaggctgttttccagagcacaaaaatatatttaaacttttccacaattagcataactgcaataccaaactctcctcca

SEQ ID NO: 45656 - DNA, 479 bp, Homo sapiens
gatatcacatacattcatatatctcaagaaatgaaagcaatgaaagagctgtgatatgatccatattttttgtttattgacaactaatgcaaaattccaaacaataatgaagcaactacagattggggaaaatagtaaatcagaaagagcaattgagagagcctttttagaaaaaagttttctcctttggaattatgttacattttgagtaattattatgatattcaaccattaatttatacatttgtttttaatttaacatatattttgagtactaaatatatcaggcactattataggtgcttgtgctaattaacaaccagttttctagaatgtgtaaagtgccatagaaaatacctcttgggttctatgctcactacctggatgatgggttcagtcatacccaaacctcagcatcatgcagtatactctgtaacaaacactcacatatatcctcaaatctaaaagttgaaatttaa

SEQ ID NO: 45657 - DNA, 511 bp, Homo sapiens
ggtatccagtataatatataatattatataatacctataatatataatgtaatatatgtaatatataatatatataatatacatgtatatatacagagtaggtttatatttacctattaaatgaatgttacataccgtggggaaacatcaaagatactcaaaatggtaggttatattttagttaggcaaacctagtgtacacatgtgaaacagtactagaatttggagctaaataagagttaatacttatgtcgtgcttaaaatgtgaacctcacaacaatcctttgaagtaggtacaattatttcctcatttttcagaggaagaaatggagacacagcaaagtaattaagtttgttgctcaagatcgtaccggaaatcataagtaggcagtctggctccagaggcggtgtggtttctctggggagctttactttatacttcgaagggacatctaagcactacttttgcagctgtaagagatgctcttttaaaatttcaaagtagcctaag

SEQ ID NO: 45658 - DNA, 160 bp, Homo sapiens
ccctgtcaccactctttccctctatttatttcaatctcttgtttggttcgaccctgcagcctcggtccccttccaggttccatgtttataagccccaaccccactgtccccatcttgtatgtgaaaacttgtctcaataaaccctttggagtaagatgaa

SEQ ID NO: 45659 - DNA, 183 bp, Homo sapiens
  misc_feature 183: n = A,T,C or G
tgaagaaaagaatgagaaactctgtctagagagacgtaggattgcatacctttgcttaagctagtgtaagcttgattttggaatcagccagtgggaatacttttctgtggctgtaattttttttttttttggttaacgtgtacccgaggttagtttgtttaccattttatttctgtattcaan

SEQ ID NO: 45660 - DNA, 150 bp, Homo sapiens
agcaatatcaaccattaaccttccctctacacttatcatcttcacaattctaattctactgactatcctagaaatcgctgtcgccttaatccaagcctacgttttcacacttctagtaagcctctacctgcacgacaacacataaaaaaa

SEQ ID NO: 45661 - DNA, 156 bp, Homo sapiens
cggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaaaaaaaaaaaaaaaaaaaaaaaaaa

SEQ ID NO: 45662 - DNA, 440 bp, Homo sapiens
gcaggtaaacattacagtacagaagaaagtgagtcagtggtgggagagactcacaaagcaggacaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccacatgctggcagttgtggaactatcaatgcagcaattggagtcactacgtcaccggtgctgccttctctgatccagcttcctgg

SEQ ID NO: 45663 - DNA, 410 bp, Homo sapiens
gacttgatgaagaaggaaaaggggctgtatacagctttgatccatgtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgttaccttaaggaaggactgatctgtgtgctcttatcaccaatcagttcagacctggttgattttgtactttggaactgtaccttggatggttttgtttattaaaagagaaacctgaagtta

SEQ ID NO: 45664 - DNA, 279 bp, Homo sapiens
atgcgtggataaagtaactgggatatatatacatacaatggaatactcctcagccataaaaaggagtgaattaatggcattcgcagtgacctggataagattggagactattattctaagtgaaagaactcaggaatggaaaaccaaacatcgctatgttctcactcgtaagtgggagctaagctatgaggatgcaaaggcataagaatgacacaatgaactttggggactcagggagaaagggtgggaaggggatgaggaataaaaaaaaaaaaaaaa

SEQ ID NO: 45665 - DNA, 583 bp, Homo sapiens
accgggaatcggccattatggccagggagaataaacattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccaaggttccacagaagctttgtttcttgggcaagcagaaaaattaaattgtacctattttgtatatgtgagatgtttaaataaattgtgaaaaaaatgaaataaagcatgtttggtttccaa

SEQ ID NO: 45666 - DNA, 271 bp, Homo sapiens
cttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagatttttttcttttccatacttgtatattgaacattcaaacttgaatggaaagttgattttgtctgtatttgaagtacttctattttaagttaataaatctttttgacaagaaaaaaaaaaaaaaa

SEQ ID NO: 45667 - DNA, 592 bp, Homo sapiens
gaggcattgaggcagccagcgcaggggcttctgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttacgcatttacctaaacgcagacgaaaatggaaagattaattgggagtggtaggatgaaacaatt

SEQ ID NO: 45668 - DNA, 289 bp, Homo sapiens
aagaacattattatatgattaacaatgtcatgttccaggtttaacaatttcataggccaaaaaaaaatttcttcttaaaaactagttttataaacgcagaatatattccatgagtaactgctggtattttttaagaaaatatattgtgcaattgtggctaccacgtactgctggcaaagcattattatttatgtaaaatgtgaaaaaaaaggtgtaaaaatttttcaactgcctatgatcatgatgaaaggttactgccttcttacaaaaattatattggcatcttcta

SEQ ID NO: 45669 - DNA, 488 bp, Homo sapiens
gattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccgggggagaacttccaaatgttaattttttttttttg

SEQ ID NO: 45670 - DNA, 685 bp, Homo sapiens
cagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctcaagctattgtatgtttggattgcagaagaatttgtaagatgaatacttttttttaatgtgcattattaaaaatattgagtgaagccaattgtcaactttaattaggatacctttgtcggccaccacctagtgtaaataaaatcaagtatacaatctaaaaa

SEQ ID NO: 45671 - DNA, 245 bp, Homo sapiens
gggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttgatgctg

SEQ ID NO: 45672 - DNA, 133 bp, Homo sapiens
gagccgtggccttggaaagggccacaagttccaccacactattggtggctctcgccgggcagcttggagaaggcgcaatactctccagctccaccgttaccgctaatataagtaaagtttgtaaaattcatac

SEQ ID NO: 45673 - DNA, 270 bp, Homo sapiens
cttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttcaaaaaaaaaaaaaaaaaaaaaaa

SEQ ID NO: 45674 - DNA, 371 bp, Homo sapiens
gaaatcagtgcgtactgcaaagtacagccaataatttttgttctttgttttcacccccaccctcactggaattctcaccaaaaatagtttgatacttaaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaaatccctgtgtatatgaaagtgcataataaatatatttgctttacagagaaaaa

SEQ ID NO: 45675 - DNA, 314 bp, Homo sapiens
atatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcaaaaaaaaaaaaaaaaaaaaa

SEQ ID NO: 45676 - DNA, 382 bp, Homo sapiens
acaaaagaacaatacctgttaccacaacatcacacttaagtacctagcccatagaccctataaaggaaccgcagaatagaaactacaaccagctaacaacttcacaataggatcaaaacctcctatatcaatataaatctggaatgtaaacagtcttaacacccccacttaaaaggcacagtgaattaaattaattattgaatgaaaaagaaaaaaaaagaaaaaacaagaccaatctgtctgctatcttcaagagacccatcttacatgtaatgacatctataggctcaaagtaaagggttggagaaagatctgcataaaaatggaaaaccaaaaagagcaaaaagatattcttatatcaggtaaaacagactttaaacca

SEQ ID NO: 45677 - DNA, 748 bp, Homo sapiens
tacccctataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctggctctttactatgaccagagtttattaattgggcctatttcattgggggaaaaaatgccaaaccagaacactggaatgactagcctggaaatattccactttttcatgggaaagcagggttctaaaacgaattcctgtggggggccaaactttttgctcttcgcccaaaaattttttttagcctttaaagggggggccccttggatggggcccctttaaggggaagaaaattttttcccccggaaatttaacctttaaaaaatttatttggccctttttttgggtttttccccaaaaacc

SEQ ID NO: 45678 - DNA, 153 bp, Homo sapiens
ggatacacaggataccctgacttctaaatcaagagagaagacctttcgtgggattcatttcccctttcccagtctgcggtattttatgcctataatggaattttggctttaggaatgcacagattcatcactagactcagaatctggagcaaa

SEQ ID NO: 45679 - DNA, 598 bp, Homo sapiens
gagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaa

SEQ ID NO: 45680 - DNA, 697 bp, Homo sapiens
ctctgagctcaaggatatgtcaatagaaactggtaaaactgaaaagcaaagagaaaagacactgaaaaatataggacagaatatccaagaactgtggtacaactgtggtacaaatgtatgttattttccatgcaacatacatggagaggcaataccagaaggagaggaaataggaaataagagaagtatttgaaaaaataatggctgagaatttcccccaatgtcagacaccagaccacacattcaggaagcacagagaacacaagcaggataaatgcgaaagaatgacagccaggtatatcatattcaaacttctcctcagaaattatgcaagcaagaaaagagtgaaatgaaatatctgaagcattttgacaaaaagaaaatccaccgacctagaattctataccctgaaaaattactcttcaaaagtgaaggataaattaagactttcttgggcaacaaaaattgaaggaatttgctgccaataaacctgccttgaaaaaaaaatgatacgatacattcttcagagaaggagaatgatacatctcagaaactgggttgttcttaaaggaagggagagcatttcagaaaaaggttatttttaaggggaaaattaaaccttaatttttctaccctaatttaccaacaaataacagtttgttcaatggtgtaaagggacaaaggttttaaaatgccc

SEQ ID NO: 45681 - DNA, 607 bp, Homo sapiens
gagtgagaaaagataataatccagcacttttgcattccaacaaatgacagtattgaagcaccatcacactgatatttcaagaaaccccattttgtattaggacacaaagataatttaaactttgtttatagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccaattgccaaaaaaaaaagcttttcttgctacaaaaaataagcaattttcttgagccttattgactttattacattttctgtttagcagcatttttcactgcaatgttaaaataaatatgacattgaattcg

SEQ ID NO: 45682 - DNA, 369 bp, Homo sapiens
gtcctttctgggctcggacttaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgc

SEQ ID NO: 45683 - DNA, 599 bp, Homo sapiens
ggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacaagatcctccttataatccactttgagtgcggccccatgtttgatggtatctgagcaggttgcccc

SEQ ID NO: 45684 - DNA, 479 bp, Homo sapiens
acagacggcacccaaaccctgagtggagaaactggacaataaagaagacagggacaggggagagagaaacagagatacatagatgagtttttatcatctataatttcccttgcaggaaagaagtgattaattattaatagtgagggtgattgatttttttaaattctgaatattgatatttcttagaccataggttcatttttttcaaaaagaatttgtggagtacctactatgatcaagagaatgtgcttatggatttaagaacccatgatttaataatcccttgttttgtttttattattttataacaaagtaatagtttttagctttcccatgatacaaatagactttagtgacaataaaaatattagaagaaactaatgatttctagccgctagcaaacaagttgctttgttctttcaacttttcatccgggtattaaatatcaatggccactgctcccccgacccccaccaacc

SEQ ID NO: 45685 - DNA, 520 bp, Homo sapiens
attacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgggactaatctcatctctgttttggacgtttactagactttgatttccttaatagcccatttctgttaacctctt

SEQ ID NO: 45686 - DNA, 172 bp, Homo sapiens
tacctgagtaggcctagaaataaacatgctaagcttttattccaagttctaaccaaaaaaataaaccctcgttccacagaagctgccatcaagtatttcctcacgcaagcaaccgcatccataatccttctaatagctatcctcttcaacaatatactctccggacaaaaaa

SEQ ID NO: 45687 - DNA, 246 bp, Homo sapiens
aacatgaaacatatcaaagaggaggaagataggaaaatagtaaagtacaagcctgagatgaatatacatatgggcaggatttgtctgagcaatggatacttttggcatcttaacactaagagggatcctaaaaggaatttgtattatttagaataggtccaactgcatgtgaaagatatgcccaaactagaactagttatacaagttcacagttatttctcttaaaaaaaaaaaaaaaaaaaaaaa

SEQ ID NO: 45688 - DNA, 513 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtcattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgcttaaaataatttgaaggcgatcttttaaaaagagattaaaccgaaggtgattaaaagaccttgaaatccatgacgcagggggaattgcgt

SEQ ID NO: 45689 - DNA, 420 bp, Homo sapiens
ggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggatggcctttggatctctcttccaagcctttcctgacttcctcttagatcatagattggacctggttttgttttcctgcagctgttgacttgttgccctgaagtacaataaaaaaaattcattttgctccagtaaaaaaaaa

SEQ ID NO: 45690 - DNA, 231 bp, Homo sapiens
gccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaaaaaaaaaaaaaaaaaaaaa

SEQ ID NO: 45691 - DNA, 351 bp, Homo sapiens
aaagcactggtattacaggtgtgaaccacattgcccagtcttaaaatatattcctaataataattattttagtggctgtgtaataatccctcgttgaatgtacccgtgcaccataattcatgccattattgttatacattcagagtattgcagaaataacactattttaagcaattctgcagtgaatatctttgaaattttattctttaaaaaataattccggctggcgcgctggctcacgcctgtaatcccagcactttgggaagccgaggcagacggaccacctgaggtcaggagtttgagaccagcctggccagcatggcaaaaccctgtctctgctaaaaataccaa

SEQ ID NO: 45692 - DNA, 489 bp, Homo sapiens
cggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgta

SEQ ID NO: 45693 - DNA, 428 bp, Homo sapiens
cagaatggtgtgtctcagctaatccaaagggagtttcagaccagtgcaatcagcagagacattgatactgctgccaaatttattggtgcaggtgcagcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 45694 - DNA, 609 bp, Homo sapiens
gaggcattgaggcagccagcgcaggggcttctgctgggggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaacccgaaggtgattaaaagaccttgaaatccatgacgcagggagaattgcgtcatttaaagcccagttaacgcatttactaaaccccagacgaaaatgggaagattaaattgggagtggtagggtgaaacaaatttggggaagaaaa

SEQ ID NO: 45695 - DNA, 619 bp, Homo sapiens
actactaatcaattttcatccttaataataacagccctagtaataaaactagaaatagccccctttcacttccgagtcccagaagtaacccagggaacttctctaatgtctggcatacttctcctcacatgacaaaaactagcccctatctcaattatatttcaaattttcccatcaataaacacgaccagtctcctatctatcacaatcctatccattaacgtaagcggttgaggaggacttaatcaaacacaattctgcaaaatcttaacctactcctcaattactcatataggttgaatgatcccagtactaacttataatccaaacgttaccattataaatctgattatttaccttattttaacaactaccacatttctagcacttagcctaagtataagcactacaaccctgtcactgtctcacacttgaaacaaattaacatgattaacacctatagtttcactaattctactatccctaggagctttacctccattaacaggatttctgcctgaatgagtcatcattcaagaattttcaaaaaacaatagtcttattaccccaaccattatagctatcataacactactcaacctgtagtttatatatgcct

SEQ ID NO: 45696 - DNA, 566 bp, Homo sapiens
gatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactccccttttcctatttgaatttctttggtgctgtagaaaacaaaaaaagaaaaatatatattcataaaaaatatggtgctcattctcatccatccaggatgtactaaaacagtgtgttcaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttgcgttaataataaaatgcctttgtatat

SEQ ID NO: 45697 - DNA, 300 bp, Homo sapiens
gactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaatcaaaa

SEQ ID NO: 45698 - DNA, 588 bp, Homo sapiens
agcattacaggcatttgtgcctgcttgggggtatatgcacgaaaaagaaatggacagatgtgactttgaaaggcctactgagtcaaacctcaccctgaaaacctttgcgctttagaggctaaacctgagctttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggtaaaaaggaaaacttttatccctagggaaaaaacatttagaaaaatgtattcagtgtatccaaaac

SEQ ID NO: 45699 - DNA, 517 bp, Homo sapiens
cactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactgggagaaataggaatttgtgaactcctaaaattgtagcaactttgaaaggttagtgttttatttacctgac

SEQ ID NO: 45700 - DNA, 215 bp, Homo sapiens
caagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttaaaaaaaaaaaaaaaaaaaaaa

SEQ ID NO: 45701 - DNA, 686 bp, Homo sapiens
gccgtcctgacagagttcacagcatatattggtgggttcttgtccatagtgcatctgctttaagaattaacgaaagcagtgtcacagacagtaaggattcaaatcatttgccaaaagtgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggctttgagaatgtaactgatctgcagtggctcattctagatcacaaccttctagaaaactccaagataaaagggagagtttctctaaattgaaacaactgaagaaagctgcatataaaccacaacaacctgacagagtctgtgggccacttcccaaatctctggaggatctgcagcttactcataacaagatcacaaagctgggctcttttgaagggattggaaacctgaccttcatccatctcagcacaatcggctgaaagaggatgctgttcagctgcttttaaagggtctaaatcactcaaaaaccttggccttg

SEQ ID NO: 45702 - DNA, 265 bp, Homo sapiens
gaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaaaaaaaaaaaaaaaaaaaaaaaaa

SEQ ID NO: 45703 - DNA, 352 bp, Homo sapiens
  misc_feature 2, 5, 6, 7, 10, 11, 12, 13, 14, 15, 16, 17, 18, 19, 20, 21: n = A,T,C or G
gntgnnntgnnnnnnnnnnnnaccgggaattcggccattatggccgggattctaagaacactgagagctgtttatgttatgagagtgtcatggtcattttctactttggaaaaataattatagcaaaagggtgataaatccataggagagaggcaagactagatgtaaaaaccagttagaagtagggttgccagataaaaaacaggatgcctgattaaattagaagttcaggggaaaaagtgagtttcagataaacaaattactttacagtataagcatgtcccatatattacaggttatatgcaaatgtcctaaggacataaaaagtgttgctttagtaagaaggaagcca

SEQ ID NO: 45704 - DNA, 379 bp, Homo sapiens
aagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagccacacacccatattgtgtgttctgtgaatgctagctctcttgaatttggatattggttattttttatagagtgtaaaccaagttttatattctgcaatgcgaacaggtacctatctgtttctaaataaaactgtttacattcaaaaaaaaaaaaaaaaaaaaaaaaaaaaa

SEQ ID NO: 45705 - DNA, 383 bp, Homo sapiens
ggattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttt

SEQ ID NO: 45706 - DNA, 174 bp, Homo sapiens
tcctaagggagtcccagtcctacctggtggaggacctggagcggagctgaggctccttcccagcaacactccggtcagcccctggcaatcccaccaaatcatcctgaatctgatctttttatacacaatatacgaaaagccagcttaaaaaaaaaaaaaaaaaaaaaaaaaaaa

SEQ ID NO: 45707 - DNA, 250 bp, Homo sapiens
aactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttaataaactgtatttaacttaaaaaaaaaaaaaaaaaaaaaaaaaaaaaaaaaaaaaaaaaaaaaaaaaaaaaaaa

SEQ ID NO: 45708 - DNA, 547 bp, Homo sapiens
attggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaaggcaaatttatttttttcattgcacattttgcagattttatccacagtgtcattttttactgtcagaaaagataccccttttgtcattgcaactattttttaaatccagaaatctttgtacggatgtaaatgattgtagttattttgg

SEQ ID NO: 45709 - DNA, 413 bp, Homo sapiens
agagacaatgctgtgagtttctaaacatcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactaggtgtctgctgttgcaaaaagaagacattctctgcctgagttttaatttttgtccaaagttaattttaatctatacaattaaaaccttttgcct

SEQ ID NO: 45710 - DNA, 628 bp, Homo sapiens
ggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgctgagaaatatccttctctacctgttatttatcaatttttcccagtatttttatacgggaaaaattgtattgaaaacacttagtatgcagttgataagaggaatttggtataattatggtgggtgattaatttttatacggtatgtgccaaagctttactactgtggaagacaactgtttaataaaagattacattcc

SEQ ID NO: 45711 - DNA, 609 bp, Homo sapiens
gcttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgagtaagggttatcgaatggtggtgaatgaaggttcagatggtggacagtctgtctatcacgttcatctccatgttcttggaggtcggcaaatgcattggcctcctgggttaagcacgttttggggataattttctcttctttaggcaatgattaagttaggcaatttcagtatgttaagtaacacacttattttgcctgtgtatggagagatcagaaatattttaaaacgcatacataataaaagacatgtgcatggcaaaaaaaaaaaaaaaaaaaaaaaaaaaaaaaaa

SEQ ID NO: 45712 - DNA, 600 bp, Homo sapiens
  misc_feature 327, 524, 532, 534, 536, 546: n = A,T,C or G
caggcggagcttgaggaaaccgcagataagtttttttctttttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgctttttantaaaatgaaggtgacttaaacagcttaaagtttagtttaaaagttgtaggtgattaaaataatttgaaggcgatcttttaaaaagagattaaaccgaaggtgataaaagaccttgaaatccatgacgcagggagaattgcgtcatttaaagcctagttaacgcatttactaaacgcagacgaaaatggaagattaantgggagtngnanggtggaccanttggggaagatacaagtttgaagtgggaaactggaagacagaagtacgggaagg

SEQ ID NO: 45713 - DNA, 653 bp, Homo sapiens
gaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggagggatttgattcatgagatctatactgttgggaaacgcttcaaagaggcaaataacttcctgggggccctcaaattgtcctccccacgaggtgggatggaagaaaaagaacaacccattttgtagaaaggtggggatgctggcaacaagggagggccaagatcaacagggctttttaagaaagaatggaactaaggggggtccaaccaaggaattaa

SEQ ID NO: 45714 - DNA, 647 bp, Homo sapiens
gaaatgaatctgtgttaaaaagactattttaaatgtatttcctgcttttgtaagcattaaagatttataagaaaattattcaaactatttttataaaatgaaagttatgacttttaaacttattgattcctcttgcccctaccccctctttttggaagatattttgattccttataaacttttaccctaagcttatatatgttttctgtcacaagtgcttcctggcacacaggcagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttagatgggcagtaccataatttaaaaaactaatactttaaagagagagacaaagatattttgtgcctttgacaaattaaatctaatagggggaaaatgttcctaattaagcacttactagtgaaaaagatctcacaatttatgccaaatcaggtacggtatttcaagtataacacaaaaccctttggttggaaaccataggtttcagtgggcagttgccaatccaagaaaattaagcctttgagtacttagcaattccaagcggaataca

SEQ ID NO: 45715 - DNA, 513 bp, Homo sapiens
ggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcgccctatgacattggtggtcctgatcaagaatttggtgtggacgttggcctgtttgctttttataaaccaaactctatctgaaatcccaacaaaaaaaattactcatatgtgt

SEQ ID NO: 45716 - DNA, 373 bp, Homo sapiens
gagtctgaagatggcggcctcagcagcgcgaggtgctgcggcgctgcgtagaagtatcaatcagccggttgcttttgtgagaagaattccttggtccgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactg

SEQ ID NO: 45717 - DNA, 359 bp, Homo sapiens
ggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagcca

SEQ ID NO: 45718 - DNA, 503 bp, Homo sapiens
taggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctg

SEQ ID NO: 45719 - DNA, 634 bp, Homo sapiens
gacttcgaggaattctttctaagtaagttattgtttgatagtacagaaaagcaggaacaaaccaaacccactattagtagatgaaaagaaataacaaagatcagagcagaaataaatgaaattaaaaagaaaaaaatacaaaagatcaatgaaacaaaaagttgattttttgaaaagttaaaatcgacaaacctttagccaagctaagaaaaaaagagagaagatctaaataaataaaatcagaaatgaaaaaggaaacatttcagctgatactgcagaaattcaagggatcattagtggctgctatgagcaattatatgccaataaattggaaatctagaagaaatggacaaatctctagatacatacagcctaccaagactgaactaggaagaaatccaaaacctaaacagaccaataacaagtaacaacatggaagccgtaataaaaagccttacagtgaagaaaagccaaggactggatggcttcactgctgaaattctacccaacatttaagaagaactagtatcagtcctactgaaactactccgaaaaaaaatagaggaggaggctatacacactcatctctgaggcagttattaccttaataccaaaaccaggccaaaacacatcc

SEQ ID NO: 45720 - DNA, 628 bp, Homo sapiens
  misc_feature 599, 601: n = A,T,C or G
atagggagaaacgttatactccattctcattaatttcccattttgtctacttttactcttgtacataatgttgtgggtttaagagtcttttgcatttgttctgtgacacctttttttgaattgactgttttaaaacaggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtggggggggaccttttttagagtttgcatgccagcgcacggcctattgctgtgaaacagagagaaggtaaagctacctgaagcaatgcgctggaggatgaagtgtttgatagcactagggggggaaagaaaatgcatggcaaagtttcgtcctctcgtagactaatcaagcatgcaaagtgtagtgtgttgaaacggggtaagacattgccggtatcaaaagttgtaaaattaancnttattaggggaaaacaagtattttttg

SEQ ID NO: 45721 - DNA, 523 bp, Homo sapiens
gaaaaagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttatta

SEQ ID NO: 45722 - DNA, 640 bp, Homo sapiens
agagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcgggccatttagatttaaattccacttcaattaaaccaactgtttttct

SEQ ID NO: 45723 - DNA, 407 bp, Homo sapiens
gaagctctgtctggtgccttgagatccactcctatcggtccttacagccgcatcgtcaccgtgccatggaggatgtctctcttcgcacattatacacagacaggttgtatgaggccaccttgctgactgttaacaacattggatgtatacagatctgcacggagcatgtacagctgcagcattcctgaaagaattcgtaactcatccaaactgggcacatttagacatagcaggcgtgatgaccaacaaagatgaagttccctagctacggaaaggcatgactgggaggcccacaaggactctcattgagttcttacttcgtttcagtcaagacagtgcttagttcagatgctcacaaatgtcttcactctgtcttaacttggacagttgaacttaaaaggtttttg

SEQ ID NO: 45724 - DNA, 368 bp, Homo sapiens
ttttttcttttaaatgtaatacctcctcatctttccttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgcaaacccttctttagcccttcacacatcgcactgaagaatatgatgctgaaggatatggaagacacagatgatgatgatgatgatgatgatgatgatgatgatgatgatgatgaggacaactctcttttccaacaagagagccaagaagccatttttttccatttga

SEQ ID NO: 45725 - DNA, 517 bp, Homo sapiens
gacggcaggcgtccgcgtcgctagctagtcgttctgaagcggcggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatccta

SEQ ID NO: 45726 - DNA, 588 bp, Homo sapiens
  misc_feature 467, 472, 476: n = A,T,C or G
gagattctggaggcgaagaacgcaaagctgagaacatgtgaggttagtatcgccccactccgcgcctgggacgatttcttcccgggttccgatcgctttgcccggccggacttcagggacatttccaaacggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttgggaggagtcatggtctttgtgtttggcattacttttcctttgctgttgatgtttatccatgcatcgttgagacttcgggaanctcangaanaaactgggagaatacaatggaaggaataggtttgatgagggacaccgatgggtattgttctggatgcctagaacaacaggaagaagggatcaacaagactcactggactata

SEQ ID NO: 45727 - DNA, 351 bp, Homo sapiens
ggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgaggattcacaagcgactcattgacttgcacagtccttctgagattgttaagcagattacttccatcagtattgagccaggagttgaggtggaagtcaccattgcagatgcttaagtcaactattttaataaattgatgaccagttgttt

SEQ ID NO: 45728 - DNA, 500 bp, Homo sapiens
gactggatggagacaggaccatctctgacattcattggccatcaggatataccaggagttggtaacatccactcaggtgccacacctccctggatgatccaagatgaagaatacattgctgggaaccaagaaataggaccatcctatgaagaatttcttaaagaaaaggaaaaacagaagttgaaaaaactccccccagaccgagttggggccaactttgatcacagctccaggaccagtgcaggctggctgccctcttttggccgcgtctggaataatggacgccgctggcagtccagacatcaattcaaaactgaagctgcagcaatgaagaagcagtcacatacagaaaaaagctaatcatgctctctaccaactaccatgaggctaaaagcaaagtcaacaaacccctattataccttccaccaaattctttatcattgtctttcttaggaaacagacatactcattcatttgatttaataaagttttatttttcc

SEQ ID NO: 45729 - DNA, 620 bp, Homo sapiens
gtggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacagtgtagaagttaaggacattgaattggtcatgtcacagcaaatgtgtcgagagcaaaggcagtccgagcctgag

SEQ ID NO: 45730 - DNA, 533 bp, Homo sapiens
gatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatctaagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaa

SEQ ID NO: 45731 - DNA, 645 bp, Homo sapiens
ggaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacaaaatgtgttaaatttcctgtacaaaaattggttaattgccctttccttggtttgtaaacttaaccggtaaaaggggttcctccctaacggtcaaaaaaaaaaaatgcca

SEQ ID NO: 45732 - DNA, 360 bp, Homo sapiens
gatgtttacaatttcaaatcctaaatcacttcttgtaggagggttttcattaactgcagtatatacagttcactacatatgggttgtttgagttttttgtgtgctgtatttctttctgttttttaatacctggttttgtacatatctaactgtgttctcttttggttgttcagaaactggattttttttttcttacagcagtgcttaatttgtgttttttaattttgattcagaagtagtcccagctcataggtgttcatactgttacatccagaacatttgtcaggctctctgtcagctttcatgtacatagggtatagaacccatgggcgttaggcacttccggggttttttttttgt

SEQ ID NO: 45733 - DNA, 193 bp, Homo sapiens
actgaagaaactctctgtatgtcctagaataagaagcaatgatgtgctgcttctgatttttcttgcattttaaattctcagccaacctacagccacgatctttagcacagtgatatcaccatgacttcacagacatggtctagaatctgtacccttacccacatatgaagaataaaattgattaaaggtctaa

SEQ ID NO: 45734 - DNA, 317 bp, Homo sapiens
aactgacctatggcatagctcccctaaaataaaacacactccacccaactgccaatggaaacattaaacattccagaaacatatactcaccacttgaacatttatatcaatactaagaatgctggaaagaatttactcttggacatgtcactatagcatggttgccttttgagagttataattatatctcatttacaagttctaacttaaattttctattttaagcattctgtcattctaaagtgttgtgacattgcctgatggaatatttactttaactctacaacccatttaggatgccttctaataaatagatt

SEQ ID NO: 45735 - DNA, 293 bp, Homo sapiens
cagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcat

SEQ ID NO: 45736 - DNA, 410 bp, Homo sapiens
aaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaa

SEQ ID NO: 45737 - DNA, 561 bp, Homo sapiens
gggttgttcacaatgaagctttgtctaacaccattatctgatgcatccattatctgatgcatggcatatgcaataaggcagatccacagcagaccaaacaaggaagctgaattaggtaatagaactagtaattaagatggttcacctctaacacagttctgtggcctgtcccccccagagaaagattagaaatggctccagtgtaccaaataagcttcacagaagaacatgaaaattttcctccaacttttttttctttttttttcaagcagagcctttcacttagggaccaactgcttgtagatgaaataaatcaacattaattacttctagcctgatgtaatatggctggagaaaaggggtctctggaagccggtattttgtttaacttacattcgaggtgtgtaataagttgtcgctctataacttctgcggtggttccaacatctatatctgaaaggtgggaagcagctgctctgttacaattttcatgtaacacgcctggattccagggtctttccctctttaacacaacttaaagaaagtttcctgggggttggg

SEQ ID NO: 45738 - DNA, 226 bp, Homo sapiens
gctattaaaaaatattgtttgaaatacttgacatgcccaaacgtagttagacatttcacttaatgtgtaattggcttcaaaaacaagcaactggatgggcttggtggctcatgcctataatcccagcatttggggaggccaagacaggaggctctcttgaggccaggagtttgaaattagccttgttaacttagtgagactccatctctgcacaaaaaaaaaaaaa

SEQ ID NO: 45739 - DNA, 290 bp, Homo sapiens
tccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacaaaaaaaaaaaaaaaaa

SEQ ID NO: 45740 - DNA, 351 bp, Homo sapiens
actttgggaggctaaggtgggcggatcacttgaggtcaggagttcaagaccagcctggtcaacatggtgaaaacccatctctactaaaaatacaaaaactagccaggtgtggtggcaggtgcctgtaatcccagctactcaggaggctgaggcaggagaatcacttgaactcaggaggtggaggttgcagtgagctgagatcacaccactgcactccagcctgggaaaaaagaggattaggtctgggtacactggttcacaccagtaatcccagcactttgggaggctgaggctggacgattgcttgaggacaggagttcaagaccaacctgggtaacaaacatctctact

SEQ ID NO: 45741 - DNA, 445 bp, Homo sapiens
ggcagacctgacctgaataggtctctctggctttaccatgaggttccccggtgttaactgataagggggtaaaagctgactcctctcaaagcccctcatccgaaagaacaggcagaatttattaacaaataacccatagtaccatctgctgatgaggcagtggttaaatgagcttgaaaatgggctttcatttttactttatcattgtgaaatcatattaatgttttaatctagaaacttgtgccacatttcaagaagaaagctgattaaaatgttttaaatatgtattttatacctaatagaaaaagactaaatattttacatttagctgggtgtggtgacatgtgactgtagccccagcaatttggaaagctgaggcgggaggatcgcttgagctcaggagtttgaggttgcagtgagccatgattgctctgctgcactccag

SEQ ID NO: 45742 - DNA, 495 bp, Homo sapiens
gataagacagatatgtaccttataagagcaccacaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttcctgtttgtgaaatgtatgta

SEQ ID NO: 45743 - DNA, 646 bp, Homo sapiens
aattcggccattatggccggggaaaccaaaagcaccctgaggtcccttctggaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattactttttttttctgcaggtcagtaaaaggatttaagttgcactgacaaaaataccaaaataaaagtgtatttttaagttcccatttgaaattgctggcgctgctggccggatgcatttttgagtttgtattacttgataaattaacagtaataacaaggattgtatgaaccgcatggtgcttgcagttttaaatattgtggatatttgtcctgcatcagaaacgaagctttggtttttacaagattcaactgtgttgaaatcaaacctgccgcaacagaaattg

SEQ ID NO: 45744 - DNA, 336 bp, Homo sapiens
ggatttatgcaaatgtcttttctgcgtcttttgagatgagtatcaggtttttttttttccttttaccacctgatgatgaacttaatgtttccatttgtattaagggaaaacaaagtccctctgtgatttctgaaccaagctattcctaggcctgagttttattttgttgacacagaaataaattagaaggccaagcggggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaac

SEQ ID NO: 45745 - DNA, 604 bp, Homo sapiens
caaactgcaacgcatagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggacacagtgacttatttgtagttgttagttgccctgctacctagtttgttagtgcatttgagcacacattttaattttcctctaattaaaatgtgcagtattttcagtgtcaaatatatttacta

SEQ ID NO: 45746 - DNA, 517 bp, Homo sapiens
gggattggaggaaatcgagcttcggagtgcaggaggggcctctgcaaaacactagcggttgccgcaggatctgtgaactttgcaatgtggctgcaagggtggtggtggtggtggggatttggggtagctagttgttaactatggcacacagtgaacgtagtttacgatcttgaaatgaaacttacatttttctggggaaatgttcacatacagttttgtgaactgtacatcaaaatacctttttcgacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttggcccatactgtgatattactgttctgctacaataaatgtcaaccta

SEQ ID NO: 45747 - DNA, 600 bp, Homo sapiens
gataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcagggaagagtgattaagtgagggtatttacccctaaatgggccattctgcattgtatttcaggctggaaat

SEQ ID NO: 45748 - DNA, 209 bp, Homo sapiens
ccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaaaaaaaaaaaaaaaaaaaaaaaaa

SEQ ID NO: 45749 - DNA, 379 bp, Homo sapiens
aactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgccagacaatggctataaactgaattaggcagtcttaaaaaaaaaaaaaa

SEQ ID NO: 45750 - DNA, 516 bp, Homo sapiens
aaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtctgtgatgttggaactgttgccccagatggactttgcccttgtgagactttatacttttcaaggcagtttttccctctttaaaactcgccagcttttatgtagtgttttat

SEQ ID NO: 45751 - DNA, 416 bp, Homo sapiens
ggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaa

SEQ ID NO: 45752 - DNA, 600 bp, Homo sapiens
atagtatgagtctctaaaaagcaagtttttcatttgttagaggtcgttattgataaccagtctgtatagttaaggtaaaaaattaagcttttcttctatagtctgtgtccatactcacagaatgaatggcacacctgagatcaacattcacatagtttagactccaaaccattcagtctaaaatactgaaactttggaatatagggaatgatgataaaagtggatttggtttgagtagcagaaaactacttatgtccttttcttgcctttccaagaaaaatgttttttgttttttttttttaaccttgagttatcgggatattgccttgaccccatttcatttgggctaggtagatacaacttagcctttgtgatggtgacatattggcaaagttttaaataaaacttcttttgggtagaaatcattagaaaccaagcatacggcactctaatattttacggtaaaggcttaggatttttatttccacggccattaattttttagaggggttgtttccccttacacaactagaattaaggtattttccccagtttccaaaaaccctagggcctggacggtttgttccttaaaagggggat

SEQ ID NO: 45753 - DNA, 321 bp, Homo sapiens
tacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcacaaaaaaaaaaaaaaagaaaaaaaaa

SEQ ID NO: 45754 - DNA, 431 bp, Homo sapiens
gagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacctaagttctttgatttgtaccattccttcaaataaagaaatttggtaccc

SEQ ID NO: 45755 - DNA, 371 bp, Homo sapiens
attgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataaaaaaaaaa

SEQ ID NO: 45756 - DNA, 513 bp, Homo sapiens
  misc_feature 494: n = A,T,C or G
tacgggaattcggccattatggccgggaagaaggaaagaggaaaaaagaaaaaacaccaatacccagatttaaaaaaaaaaaacgatcatagtcttaggagttcatttaaaccataggaacttttcgcttatcccaggttagctgtaccagtcagtgattaagtagaactacaagttgtataggctttattgtttattgctggtttaggaccttaataaagtgtaattatgtattaccagcagggtgtttttaactgtgactattgtaaaaaaacaaatcttgatatccagaagcacatgaagtttgcaactttccacccggcccatttttgtaaaactgcagtcatcttggcccttttaaaacacaaattttaaactcaaccaagctgtgataaggtggaatggttacggtttatacggtggtaggtttttgattacagcagataatgctttcttttccagtcgtctttgagaataaaggaaaaaaaatctcnaatgcaaggggtttgtgta

SEQ ID NO: 45757 - DNA, 407 bp, Homo sapiens
aggattagaataaaaaagtgtttagagaccggtcacggtgactcacacctgtaaccctagcactttgggcacctgaagcaggaagattgcttgagtccaggaattcaagaccagcctgagcaacattgatgagaccccatctctacaaaaaaattaaataactagctggacacagtggtgcatgcctatagtcccagctgctcaggaggctgaggcagaaggataacttgagctcaggagttcgagattgcagtgagccatgattacaccacactgcactccagcctcggtgacagtgtgagactctgcctcaaaaaaaaagaaaaaaaatattcagtaaggttgaaggttttaaggtctatattaaaaagaaaaatacgttacatttctatatgttgttttcttac

SEQ ID NO: 45758 - DNA, 143 bp, Homo sapiens
gtgggtgtgaaacaaatggtgagaatttgaattggtccctcctattatagtattgaaattaagtctacttaatttatcaagtcatgttcatgccctgattttatatacttgtatctatcaataaacattgtgatacttgatgt

SEQ ID NO: 45759 - DNA, 546 bp, Homo sapiens
gccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcaatcccagggcaa

SEQ ID NO: 45760 - DNA, 717 bp, Homo sapiens
  misc_feature 484: n = A,T,C or G
gggcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtgggagatgaagaattggattctctcatcaaggctacaattgctggtggtggtgtcattccacacatccacaaatctctgattggggaagaaaggacaacanaagactgtctaaaggatgcctgggattccttgttatctcaggactctaaatactctaacagctgtccagtgttggggattccagtggactgtatcccggtgaaaaacacaattttgcccttttggaacttcaatttgagcaagttggaagtttaattagctttcaaccaaacaaatttctgcaatcgagtctaaacaaaattaagtgttacggtgggcttaaagaagctatta

SEQ ID NO: 45761 - DNA, 524 bp, Homo sapiens
  misc_feature 4, 5, 6, 9, 10, 11, 12, 13, 14, 15, 16, 17, 18, 19, 20: n = A,T,C or G
gtgnnntgnnnnnnnnnnnnaccgggaattcggccattatggccgggatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttggtcaatatgattttaaataatatatataattgttttatattatgatatataaatgtaaaatattctgaattttaatttttaataatgg

SEQ ID NO: 45762 - DNA, 209 bp, Homo sapiens
gtgagttacattattttattatattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgccttttttttttttttt

SEQ ID NO: 45763 - DNA, 363 bp, Homo sapiens
gcctttccggcggtgacgacctacgcacacgagaacatgcctctcgcaaaggatctccttcatccctctccagaaaaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggaaaaaaaaaaaaaaaaaaaa

SEQ ID NO: 45764 - DNA, 522 bp, Homo sapiens
aagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactgggtaaagcctcatttgaatgtgtgaattcaatacaggctatgtaaaatttttactaatgtcattattttgaaaaaataaatttaaaaatacatcca

SEQ ID NO: 45765 - DNA, 200 bp, Homo sapiens
gatgatgagatgaaatgagatgacaagatgaaatggtgagatgaaatgcaatgatgagatgaaatgaggtgaaatgaccttagatgaactgtaatgcgatgaaatgaaatgccataatgaaatgaaataatgaaatgagatgaaataaaatcatgaaatgatgaaataatgaaatgacaatgaaatggaaatgatgagat

SEQ ID NO: 45766 - DNA, 543 bp, Homo sapiens
gaaaaagtggagcattcatgacttgtctttcatcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaaagcgtgcataagttaacttccaatttacatactctgcttagaattt

SEQ ID NO: 45767 - DNA, 317 bp, Homo sapiens
attctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaa

SEQ ID NO: 45768 - DNA, 240 bp, Homo sapiens
atattctcacttaatagaattatagagaaatttttcatgtttttctttttctctcccactttttcatattcctctttttcatttttgcctttccgtttctgtctatgatgtaggcttctgaggagaaccaagaagcttggctttagtggtagaatgacagaacttagggatcccttgcaggctagaacaaagttctgacccttagaccaaatctttatgttaagagttttccagaattca

SEQ ID NO: 45769 - DNA, 483 bp, Homo sapiens
taatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattca

SEQ ID NO: 45770 - DNA, 417 bp, Homo sapiens
ggaccttgtattgtgtttttggccttgaaagtagcaagtgaccagaatctgccatggcaacaggctttaaaaaagacccttaaaaagacactgtcacaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactgggtgtaaatttgtacagttcatgtatattgattgtggcaaacgttgtacagatttctatattttggatgagaaatttttcttctctctataataaatcgtttcttatcttggcatttt

SEQ ID NO: 45771 - DNA, 169 bp, Homo sapiens
atatcaatacatatagatatgcttattcttgttgacagttgcataattttccattaaattgatgtatcatgggcagttaaccagttactcgctttactcttagcataactttagggaacaatgtggatgttttgtggttaaagctattaaaacagtggttcttgaccag

SEQ ID NO: 45772 - DNA, 419 bp, Homo sapiens
accaaacaggttgttgcattatctagttttgtacctcaaaaagtcaagcattaaaaaagaggcaatgaaacctgaactaatgatttatccaaatgtttcatgttgatttataaggtggctaaaatgcccatctacctaaaacataaaagtattgacacaaaagaaaacttataaaaagccaaatgttgctctataatatctggactagatgcagactcagtgccgaatgcctttatgttaagtacgtggtggttaattctacaaagcttcttaacttctaattttttcatgttttctctttcttctcttccttcttctctcccctcacccaccctccccataacatcgtgattaccatgaaatactttaaaagggctcatcattaaataattgtattctttttttagtattaagctttg

SEQ ID NO: 45773 - DNA, 98 bp, Homo sapiens
cagcattagtgtcaagtggctgccttcaagttcccctgttactggttacagagtaaccaccactcccgaaaaaaaaaaaaaaaaaaaaaaaaaaaaaa

SEQ ID NO: 45774 - DNA, 176 bp, Homo sapiens
tatgtggtaagagcttctgtcttaggtcaagtcttaataggcattgcatggtccacacagcagagaaactgtacaaatctgacaagtatggcagaggtttcattgataggctagatttgcataagcatcagatgattcatatgggacagttaccatataattgtgaagcatgtggg

SEQ ID NO: 45775 - DNA, 127 bp, Homo sapiens
cctccttacaccacaaaattattccattggtaaggcttatttagactaacttggttcccggggtggggaaaaatggccgaccataaaaggggggggaaaccttacctttgggggttttggggtattt

SEQ ID NO: 45776 - DNA, 111 bp, Homo sapiens
tgtcagtgcagcaaatttatacacaagatatacgagtatatacggcctaaagaggagtgtttggaaagagagagagagagagacgcagagcacgcgctgagtaccccctac

SEQ ID NO: 45777 - DNA, 134 bp, Homo sapiens
cttgccaagggattaatttgttggcaattccccaaggttgtttcaaaatcaattgccttaaatcttaatttacacacagagggaatctctctctcatgtggctttttgacatgtgatcacatgtgagatgatga

SEQ ID NO: 45778 - DNA, 110 bp, Homo sapiens
gtttacaggttaagggggaccggaatagggggccaatgcttaaatacacagtggcacagatacaaggtagggagagaagggggggataagtgagtgtatgagaggggaga

SEQ ID NO: 45779 - DNA, 113 bp, Homo sapiens
acatatacacgttcttccagtcacctctaatcttaaaaaattgttgaaaaggtgtctattttttatgggcgcgaaaaaaaggtttagggggaaaaataacgtgggtgtgtgtg

SEQ ID NO: 45780 - DNA, 112 bp, Homo sapiens
aaaaaagcacgcccggtaagaaccatttgagccccttttatgatggacgggacggtcgatgttttttacgcacgcttccctttccgctaagagcccttgtggctgttctttt

SEQ ID NO: 45781 - DNA, 282 bp, Homo sapiens
aagatggccctaaattcttgaagtctggtgatgctgccattgttgatatggttcctggcaagcccatgtgtgttgagagcttctcagactctccacctttgggctagctttgctgtttcgcgatatgcgacagcacagcttgcggcagggcagtcatcaatgcagtggacacgcaggctgttggagctaggcaaggtcaccatgtctgcccagatagctcagaaggctaaatgcactattatcccggatacgagccacgccactcttaatcagtggtggagg

SEQ ID NO: 45782 - DNA, 294 bp, Homo sapiens
acggttcgtttttcctttagtcaggaaggacgttggtgttgaggttagcatacgtatcaaggacagtacctaccatggctcccgaagttttgctaaaacttcggatgcgtggcattctggctaggcgtctgcgaaatcatatggatgtagcattcgggctatccttgggggttgcagctttgtataagtttcgtgtggctgatcaaagaaagatggcatacgtagatttctacagatgctacgatgtcatgaaagattttgaggagatgaggaaggcaggtatctttcagagtg

SEQ ID NO: 45783 - DNA, 301 bp, Homo sapiens
aactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttgggggattcaaaaacaggtttttgattttgagtagcagttagtgatatgagtgctgttttagcttactgacgagtaaaaggtaatagcattatatacgatgt

SEQ ID NO: 45784 - DNA, 286 bp, Homo sapiens
aaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaagacagttttactggattatggcatgtttaccagatacatgttttgatacttggaw

SEQ ID NO: 45785 - DNA, 294 bp, Homo sapiens
tggatcaggcagtggaaatgtaaagaaggatctgaagctgatggggtcaaatgaaggtgaattcaaggctgaaggaaatagcaaattcacctacacaagttctggaggatggttgcacaaaacacactggggaatggagcaaaacagtctttgaatatcgaacacgcaaggctgtgagactacttattgtagatattgcaccatatgacattggtggtcctgatcaggaatttggtgtagacgttggcatgtttgctttgtataaaccaaactgtatatggattgccacagaag

SEQ ID NO: 45786 - DNA, 302 bp, Homo sapiens
acgattcaaataattcccctcctaaaaccaaaaaggagggaaacgtcaactccattgcaattacttatcttcctcttctatctctgttatacgccggggcatagaatgatcgtatacatctctttaacaaccacaaaccttaagccatgtagatgaagttagtgcatcaacgggatacagttccatattgcttagacctccttgttttagacacactaacatttataccagattgcagattattctgcagagagggaattgcatgtgtgtgttgtatattgagtagtgatgcgtgttttcag

SEQ ID NO: 45787 - DNA, 298 bp, Homo sapiens
  misc_feature 298: n = A,T,C or G
tcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacatagaataaaatactggtcaagaagctggccaagaagtatgatgcgtttctagcctcagagtctctcatcacgcagattccacgaatcctcgggccaggtttaaatacggcaggaacgtccn

SEQ ID NO: 45788 - DNA, 255 bp, Homo sapiens
tttgtgtttttctaatgagaatactgtttttcattacctaaagaacaatttgctaaacatgagacatcactcactttgattatgtatagattacataggaagaacaatcacatcagtcagttatagttcatcttactggtaattatctgttggctcataacagatataccagcgttcatgatagcgttgcagcgattatccaggtcacaagtgtacgtagagtgcgtgtgtgcgttgtgcttgtctgtagtctgm

SEQ ID NO: 45789 - DNA, 834 bp, Homo sapiens
  misc_feature 2, 3, 9, 10, 20, 23, 32, 33, 36, 41, 45, 55, 56, 58, 82,84, 90, 110, 125, 170, 208, 210, 219, 230, 242, 267, 270,273, 274, 279, 284, 290, 291, 292, 296, 303, 306, 312, 315,316, 318, 319, 331, 334, 337, 338, 339, 346, 355, 356, 357: n = A,T,C or G
  misc_feature 361, 362, 363, 364, 365, 367, 369, 370, 375, 376, 378, 379,380, 383, 388, 389, 390, 400, 402, 404, 405, 406, 407, 408,414, 415, 424, 425, 426, 430, 431, 434, 436, 438, 440, 442,444, 448, 450, 452, 454, 455, 456, 460, 462, 463, 464: n = A,T,C or G
  misc_feature 467, 468, 469, 472, 474, 476, 477, 478, 479, 480, 484, 488,489, 491, 492, 493, 495, 497, 498, 500, 503, 504, 505, 507,509, 510, 512, 518, 519, 520, 522, 523, 524, 526, 528, 535,536, 537, 541, 546, 550, 551, 554, 558, 559, 560, 561: n = A,T,C or G
  misc_feature 562, 563, 565, 566, 568, 570, 571, 576, 579, 580, 583, 585,589, 592, 594, 603, 607, 608, 612, 613, 616, 618, 625, 626,629, 630, 635, 636, 637, 644, 645, 646, 650, 651, 652, 653,656, 657, 658, 659, 660, 663, 665, 666, 668, 669, 670: n = A,T,C or G
  misc_feature 671, 677, 678, 680, 683, 684, 685, 686, 687, 691, 693, 697,698, 700, 702, 703, 704, 705, 706, 708, 716, 718, 722, 728,733, 736, 737, 740, 741, 744, 745, 748, 751, 753, 755, 756,761, 767, 768, 769, 777, 778, 783, 786, 788, 790, 792: n = A,T,C or G
  misc_feature 806, 809, 810, 811, 813, 814, 817, 819, 820, 831, 833, 834: n = A,T,C or G
gnngggggnnaggggggggnagnggccaaagnnganaaaanccgncctaaggggnnantgagccccgcaaaaaaaaaaaaangnaaaaanaaaaaaaacaaaaaaaaaantttaaaaaaaaaaanaaaaaaaaaaaaaaaaaggggggaaaaaaaaaaaaaaaaaaaagnaaaaaaaaaaaaaaaaaaaaaaaaaaaaaaaaaaaaanangtgtggggnggggcccgggnagaataagccanagggagggggaaaacaagggggcgnacnagnnaaganggggngggacnnngaanccgcagnagnaaaccncanncnngaggaggacacnaanggnnnaaaaganaaggggggnnngagnnnnnanannaagannannngangaggnnngaaggagggncngnnnnngggaannggagaaaannngaannganangngnanangagnananannngggnannnaannnagnancnnnnnaagngggnnannngngnnanggnnngngnngngggagnnngnnnanangggagannnaggnggggngggnnggngggnnnnnngnnananngaggnggnnagngnaagnaangnggggaaganaganngggnncgngncaagggnnggnnggggnnngaggggnnnaaannnngannnnnggngnnannnngagggnngnggnnnnnaagnangggnngngnnnnngngagggggnanaaanagaagnggggnaannggnnaannganaangngnnaggcngggggnnngaaaaggnnggganggnangnancgggggaggggggnggnnngnnaangnngggaacggganann

SEQ ID NO: 45790 - DNA, 310 bp, Homo sapiens
ttcaatagagaaagaatagtgttttcaatagatgctactgggactactgaatatccatatggaaaagaatgtggtttggacccctacctcacaccacatacaaaaattaattccaaatggatcaaagacctaaatataagaactaaaactttgatctgcagtagctggaggaaaaaaaaaagagagaaatatttaaagaaaaagagaaaaaaactataaaactcttagaaggaaatgtagttggaaatcttactgaccttgcattgggcagtagtttcttaaatatgacaccaacagcacaagcaacaca

SEQ ID NO: 45791 - DNA, 189 bp, Homo sapiens
aagatcccggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaaaaaaaaaaaaaaaaaaaaaaa

SEQ ID NO: 45792 - DNA, 327 bp, Homo sapiens
aagaatcccgaaagacaatcattgaatacaaaacaaataagccatcacgcctgttcttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactcctt

SEQ ID NO: 45793 - DNA, 432 bp, Homo sapiens
gttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagtatacagtgagcacgtctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttaaa

SEQ ID NO: 45794 - DNA, 542 bp, Homo sapiens
agggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggcccttaactcatctgttatcctgctagctgtagaaatgtatcctgataaacattaaacactgtaatctaaaaaaaaaaaaaaaaaaaaaaaaaaaaaa

SEQ ID NO: 45795 - DNA, 537 bp, Homo sapiens
ctactacagcaccaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtaggtgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtacaactagaaaattcaaagccatatttagggaacattttttctgaggggcaaaagaataaaggaccaaatttctagctcatatcattgctttaaacatagagtc

SEQ ID NO: 45796 - DNA, 643 bp, Homo sapiens
gcgggacgagggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacatttgtggctggtttctgaacacattctaactgtgcaaaattatcttggccttggcgtgtaatgtgaggtttacctgatctctaatgaaataaatacctaag

SEQ ID NO: 45797 - DNA, 585 bp, Homo sapiens
agtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaaccgggtcttcggcaggttacgggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgt

SEQ ID NO: 45798 - DNA, 604 bp, Homo sapiens
atatttggaaaacatttaatgcactaactttaaagaaattgaaaattcaggtggataaatagtcttacaaaagacaatgtgctttatgttatacctatagctttggtcccatctttaattgagaaacatttatctgtgtaaaacatatttttggataaatatatacactatacagggtgctatcgcaacagaggaggctcaaaaaggcatttgcggaaaatatttggttcccttttctataatcatcctttaagattcttatagctacatttggtttattcatcatatttacagtagatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggcaccaaatttttgccattaaaaactggcattatactgaactatacattgagaaatcaatcaaaataaaaatttttactttcaaaaaaaaaaaaaa

SEQ ID NO: 45799 - DNA, 411 bp, Homo sapiens
ggctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaagggaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataatttg

SEQ ID NO: 45800 - DNA, 440 bp, Homo sapiens
gggcttttgttgatgagggaggggaaacttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaaattttaagcaaatgaaagctaccaatttaaagttacggaatctaccattttaaagttaattgcttgtcaagctataaccacaaaaataatgaattgatgagaaatacaatgaagaggcagtgtccatctcaaaatacggcttttacaaaagcagaataaaagcgaaaagaaatgaaaatgttacactacattaatcctagacta

SEQ ID NO: 45801 - DNA, 162 bp, Homo sapiens
ataatctaccctgactaaagcttgaaatgctacatttccaaggtgaagatgtgtgggcacatgttatggcagattgaaaaggatctcattccatgggaaaaaaaaaatcctgtcttgttcataaattgacaatgtcaataaattgaaatatggttcactgct

SEQ ID NO: 45802 - DNA, 194 bp, Homo sapiens
ggacctaaattcgtagcaaattctgtggcagttttaaaaagttaagctgctatagtaagttacttggcattctcaatacttgaatatggaccatatgcccaggggaaggaaatagcattgcactttataaacactgtattgtaaggggaaaatgcaatgtcttaaataaacctatttaacattggcaccaaaaa

SEQ ID NO: 45803 - DNA, 167 bp, Homo sapiens
attgacattgagaaattgacgttaagaaggttctcattgtcttactaacaaaccgtttcgtctcattaattgttcgtgaaattgagttgcttttgcatttttacttgcagtcatcagttaagcatgttgcatacctcgagttcacagaaggtgttggctttgcaggg

SEQ ID NO: 45804 - DNA, 227 bp, Homo sapiens
tttgctttttataaaccaaactctatctgaaatcccaacaaaaaaaatttaactccatatgtgttcctcttgttctaatcttgtcaaccagtgcaagtgacccgcaaaattccagttatttatttccaaaatgtttggaacaagtataatttgctaaagaaaaatgatacttctctttttgtgctgttccaccaaataaaattaaaatgctttttgttttatttttt

SEQ ID NO: 45805 - DNA, 109 bp, Homo sapiens
gcagacaacctatggttgtgaggatctgacactctcccattaatatggtcctatttacttattcaaacaatatggtgtttatatgactccaattatgcaatctactata

SEQ ID NO: 45806 - DNA, 179 bp, Homo sapiens
cacatttatcgtacgtcacagtgtatggtgaatatatcacccccccccgtggtacttcgctcatcaggcataatgtctaaaatctaatatacataatccattaagtggttgaaaggaaggaaataatggaattgcttaattggtaatatggccgtaaggtttggccttgaactaaaaat

SEQ ID NO: 45807 - DNA, 244 bp, Homo sapiens
acactttgacatcaggtaatgaaggacaaggatccctgagagatgagaaacaaacaaggtaagccctgtgattctaccaacttatttccttgagtttccagaccttggagaaggaagattgggaggagtacaagcagagccttgcagacttctgatattaggagatgatgttgaaggtcttgagaaacccattgagggctacaaagatttttggggtataaccccccgggagagtatagttttc

SEQ ID NO: 45808 - DNA, 213 bp, Homo sapiens
ccatggatggtggttttcagtttagctacggcaatcctgaactttctgaagatgtccttgatgtgcagcttggatttcttcgacttcttcttcagccgagctttccagaacatcacatatcactgcaaaaataggattgcatccattggtcaggcccgtggggaatgtaaaggggccctttagctaattgggtcaaataaaggggatttcagg

SEQ ID NO: 45809 - DNA, 223 bp, Homo sapiens
tattctgcacaaaagggtattagtcactgtaccactggctttactacaggaaagggtgccattcagtttaattcaccctttgtcagaaaaggagttggaggggtattaacagcttagggggcaggcattaattaaaaggggtactctaaatgtacccctattctcagacacaggaaggggatttatgtgcacatgtataaaatgtttaaactctttgtatata

SEQ ID NO: 45810 - DNA, 133 bp, Homo sapiens
atctagaacttcatcgccctctgatcgccgatcactctgagaaccacctcgctcataaacaaaatggccatgtgggtcccctgcccttggaccgtgacaatcttggcctattcggtgtgttaattgggggccg

SEQ ID NO: 45811 - DNA, 204 bp, Homo sapiens
tagtcaagaatagcattattctcagaggctttcaggttctcctctgtcattcgggtcagccgtctcaatccatttccggggggacatttggttttacaacagtgggcttttataagggacttgtatcctttacaggaacttttttggggcaagagtttgggggataccaatctataggcacacacatatcggggggccctttta

SEQ ID NO: 45812 - DNA, 111 bp, Homo sapiens
aacaataggtctattattagagtcacctatgacaaaaaataggggttacctagataatgccaaagtcagcatttgttccgggttcccttgtgtgatctgtttgggctatgt

SEQ ID NO: 45813 - DNA, 253 bp, Homo sapiens
aatatatatgtcaatatttagtaaagcttttcttttttaatttccaggaaaaaataaaaagagtatgagtcttctgtaattcattgagcagttagctcatttgagataaagtcaaatgccaaacactagctcttgttattaatccccatcattactgggtgaaagcctcattttgaatgtgtgaattcaatacaggctatgtaaaatttttactaatgtcacatattttgaaaaaataaatttaaaaatacat

SEQ ID NO: 45814 - DNA, 203 bp, Homo sapiens
accaaacccttaagtaggaaagtcacccaaacacttctgctttcacttaagtgtcttgcccgcaatactgtaggaacaagcaatgattcttgttactgtgatatttttaaatatccacagtacttcaattttttccaaatgatcccagtaattgccaagaaatatactttctctcaacccgttatttaacaatatttccccgt

SEQ ID NO: 45815 - DNA, 121 bp, Homo sapiens
tttggtcaaagacttggacaaggaaggaaaaaagggaaggagatacattatagaaaccagatgttaaaaactgataaagggtgaaccaagccccttccttgttaaaatctaacccaacccc

SEQ ID NO: 45816 - DNA, 160 bp, Homo sapiens
ttgaccctaaccaaggatgcaaattggatgctatcaaggtattctgtaatatggaaactggggaaacatgcataagtgccaatcctttgaatgttccacggaaacactggtggacagattctagtgctgggaagagacacgttttggtttgggggtcccc

SEQ ID NO: 45817 - DNA, 210 bp, Homo sapiens
ataggctctgcccagatgccatcacatccctgatactgtgtatgctttgaagcacctttccttgagaagggaagaggggatctttggacttcggtcttgtgcttcagaccctggattcacaaaagccaaaccagctcattttaacaaaggggctcccttgttaggggcaagggtgtcccctgtcccacggttttttagaaaggttttttt

SEQ ID NO: 45818 - DNA, 213 bp, Homo sapiens
aaatgttttgaaatgatatgaccaaaattttaagtaggaaagtcacccaaacacttctgcttttaactaaagtgtcctggcccggattactgtaggaccaagaatgatctttgttactcgtagatattttaaaatatccacacgtccctacactttttcccaaatagatcctatgtaatttcgcctgagaaatatctctctctcacctcttat

SEQ ID NO: 45819 - DNA, 155 bp, Homo sapiens
cctttaagtttctaagttgtgcttcagtgacagctggagggttccaaatcaaatatgttgcaatggatcctgtatccaaatccagtcagggaaaaatacagggaacttcttcttcttggaaaaaaaaccttttaaggttggaggttttgcccctt

SEQ ID NO: 45820 - DNA, 111 bp, Homo sapiens
cattgtgcaatacagtttcattaactccttccctcgcttccccaaaaatttgaatttttttttcaacattcttacacccccttatgggaaatgtcaaccctttgtaaggaa

SEQ ID NO: 45821 - DNA, 212 bp, Homo sapiens
tcctagcttgataagcacttggagggggacttggaaggtgagaaagatactggcattttctcatgagtctccaagcccacttgaaaagtcacaattaaaggatgcaaatagccctcttcgttttttggggcccccccgattttggggacaatattttgtacccccgacaatcccaatttaaattgtggggagaaaattccccacagagtttt

SEQ ID NO: 45822 - DNA, 207 bp, Homo sapiens
cctgcaggacggaaccatgaagagccttatccttcttgccatcctggccggcttagcggtagtaactttgtgttatgaatcacattgaaagcatgggatcttatgaacttaatcccttcattaacagggagaatggcaaataccctcatatcccctcagcagagatggagagctaaagtgcaagagagggtccgcgagccctctgag

SEQ ID NO: 45823 - DNA, 149 bp, Homo sapiens
tttttatgttagaggtgagagctttgtatacactggagatttggtgtgatctctcttggctagggttttcttggtgggagctctttatactcaattaatttgtaattcgcgatttggctcttcaggggttcaatttaagactttaaacc

SEQ ID NO: 45824 - DNA, 110 bp, Homo sapiens
gcaagagacagtcttgcagaggtaaaccctggttgtgtaaatgttcaccaaagaggctatagagccccatatgtagtgaaaagtcaaaccccaatccatataaggggagt

SEQ ID NO: 45825 - DNA, 200 bp, Homo sapiens
acctgcaactttaacagcagcgggactgaacaagagtacagtatagggcttatattgtatgagtcttagagaagttggattctacatagctggtggccttgtagctgtgtcaaaaaaagaactggctaaatacagacgtttgtaaaacatagtcgtgcttaagagactagggaaatgagtaacagtagaagaatttgtct

SEQ ID NO: 45826 - DNA, 132 bp, Homo sapiens
  misc_feature 26, 27: n = A,T,C or G
tctgatcctctctacctaccactttnnttgattatctcctgggtattttggtcatataggtgggatcaaagtcctgtccaccaccaaacttaaggtactaggattttggggggattttttttttttaaccgv

SEQ ID NO: 45827 - DNA, 155 bp, Homo sapiens
  misc_feature 31, 32: n = A,T,C or G
atattttagcttagggctggtagctaggttnntctctcctctccagtcggagacctctcccgcaacatgctccgccagatcaatccggtcaaggccaaggaaggatcccagcttgatcccctctttgtatttattcggacctggagctattggag

SEQ ID NO: 45828 - DNA, 252 bp, Homo sapiens
gagtctctagagctggatggtcctcaaaagtcttgtccaaggaatgccaaccgttcaccggggctctgagaaacgacgcaaatctctgagctgggggaccacttggagaaccgccttagtaccagtcctgatctcggaaggccaagcttcttttgcatctaaggggctcctggcgcccagaggaggcagaagatgtctcttagctagagtttctacccacatgatgagactcagacctcccgctgcactaga

SEQ ID NO: 45829 - DNA, 140 bp, Homo sapiens
ttacggaaaggaacagattgttcctaaaccagaagaggaggttgcccagaaggaaaaagatatccagaagatactgaagaaacaaaaacttatggcacggggagtaaatttcagcattaaaataaatgtacctcaaagca

SEQ ID NO: 45830 - DNA, 136 bp, Homo sapiens
cagcttaaggttcatggattctaaaatgaacctaaatacgtggagaatttcttgaatagtttgttctctaaacccggtttggctgccttgtgaaatgaattccctgccagtaaaccgggcttttcaatttatttaa

SEQ ID NO: 45831 - DNA, 164 bp, Homo sapiens
ggatacacaggataccctgacttctaaatcaagagagaagacctctcgtgggattcatttcccctttcccagtctgccctattttatgcctataatgggaattttggctttagggatgcacagattcatcactaggcctcagaatcttggggcaaaaaaaaaaa

SEQ ID NO: 45832 - DNA, 146 bp, Homo sapiens
gaatgagagataaatgagaaatggagagaagaaaactcaagaaatagtgagcaaattgtggaagtcgagagatttaattaatgaatattcttctcagcttggagatgaaaattttggacatatgttaaccagggarattgattccr

SEQ ID NO: 45833 - DNA, 148 bp, Homo sapiens
  misc_feature 26: n = A,T,C or G
tttattgcagtagcttaaaatttttngtgagaaaattcctgacttgaaaaataacccttatataagtacaagtgaattgtgacaaatgacgtaaaaaatgggcaattcatgatgttctgtaaactaggctaaatgaggattcaaggat

SEQ ID NO: 45834 - DNA, 230 bp, Homo sapiens
  misc_feature 31, 32: n = A,T,C or G
taataaataaacttcaacactctttatgatnncaacactgtgttatattcttggaatcctagcccatctgcagagcaatgacctgtgctcacccagtaaaaagataagcccttctttcctgaaataggcaaatacgaaattagaaaggccccccctattttgagtacctcaactgggcagaaacacaaaattgtattctatgagtccccagagatgaaaaaaatttatac

SEQ ID NO: 45835 - DNA, 307 bp, Homo sapiens
tggttgcacgaaacacactggggaatggagcaaaacagtctttgaatatcgaacacgcaaggctgtgagactacctattgtaggatatttgcaccctattgacattggtggtcctgattcaggaaatttggtgtggaccgttggccctttttgttttttattaaacgaaacctttattctgaaattcccaacagaaaaaactttagctccatatgtgttcctctggttcctaatcttgtcaaccagtgcaagtgaccgccaaaattccagttatttatttccaaaatgtttggaacagtataatttg

SEQ ID NO: 45836 - DNA, 296 bp, Homo sapiens
gggaattatgagtttttcaattagtaacattcatgttctagtctgctttggtactaataatcttgtttctgaaagatggtatcatatattccgtctcaatctgtttatttacaggggaggatttatgtttggtgagctatattagtatgtatgtgtacctaagggagtagtgtcactgcttgttatgcatcatttcaggagttactcggatttgttgttctttcagacaagctttgaatactaaattatagtgtagacaagaactcgaaaccaggaactctggagttcatcagagt

SEQ ID NO: 45837 - DNA, 282 bp, Homo sapiens
ataactgaaaatgtgctatactgcatactttttaaatgtaaagatatttttatctttatatgaagagaatcacttaggacatggctttgtgattcaatctgtaaactgtgtattccaagacatgtctgttctacatagatgcttaggccctcatgcaaatcaattactggtccaaaagattgctgaaattttatatgcttactgatatattttacaatttgctatcatgcatggccctgtaaagggtacaaggctccacaataaaaatgtgttaacgggtca

SEQ ID NO: 45838 - DNA, 280 bp, Homo sapiens
ctaaaccacctgaatcctgacaagtttgaatccacagctttagatatgctaatcaaagcggcaacaagtgatcttgaacactattacaagactcgtcatgaagaatttaaaaaatatgaaatgatgagggaacatgaaaggagagaatatttaaaaacattgaatggtagaatagagaaaagaggaagagtctacatttgcagaaatggaggaaaagcatgtaaatcaccctaaagttaatcacccaggaagcaaagatcaactaaaaggggattgggag

SEQ ID NO: 45839 - DNA, 208 bp, Homo sapiens
cattcctatcaatccaaattccctctggagtttcatgttatgcctgttgcaggcaaatgtaaagtctagaaaataattgcaaattgtcacggctacctctatatactttggctgggtccatttttttttcccctttgagttaagcatgcactgtgagagggggaagccttttttatctggggagaaacaagagaccaatcttttttca

SEQ ID NO: 45840 - DNA, 144 bp, Homo sapiens
ggttgagctacagtcatgacttttggcgtctactttcctccaactttccaccccacaaattaccggggaccattatttttagctttggcctatttggttttgggggggggttcccccctcctgtattcttcctgagaccagggg

SEQ ID NO: 45841 - DNA, 118 bp, Homo sapiens
tcatctattatatactatatgctacaagctgacttattatatatcactgcactagtataagtgaaacaaggactgaaatgttctgtattcgtgtttgaacgaccagccaactaagctg

SEQ ID NO: 45842 - DNA, 280 bp, Homo sapiens
  misc_feature 37: n = A,T,C or G
cgagggaatgagaaagccctgaagagggcagtggccnagtgggacctgtctctgtggccattgatgcaagcctgacctccttccagttttacagcaaaggtgtgtattatgatgaaagctgcaatagcgataatctgaaccatgcggttgtagcagtgggatatgtgaatccagaagggaaacaagcactgggataattaaaaacagctgggggagaaaactgtgggaaacagaggatatatcctcatggctcgaaataagaacaacgcctgtcgcattg

SEQ ID NO: 45843 - DNA, 274 bp, Homo sapiens
gaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgttgccgtcagcattcaccaaat

SEQ ID NO: 45844 - DNA, 184 bp, Homo sapiens
  misc_feature 36, 37: n = A,T,C or G
aacggagacaggcatctacagcagggttcagaattnnccatgatgattggtgagttgagaagtggacttctatgatgttgatcctagaggaacatgcccagcctgagaggggtcagagacacattaatgagattggtcagcaccgttatgggattcagatttctcgaacctttcggaagagcct

SEQ ID NO: 45845 - DNA, 193 bp, Homo sapiens
gttaacagaaggcttttagacagaaagaaaatgatacccgatggaaactgaatctgcacaaagaaataaaaagcacctagaaaagggtaaatatgaacataaatacaaaagactgcttgtttttaaaaatatctttaaaaaacaattaactgtttaagcaaatattatacaagggattatgggagtaaaatct

SEQ ID NO: 45846 - DNA, 277 bp, Homo sapiens
gaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgttcctaaacactcatgccttatg

SEQ ID NO: 45847 - DNA, 275 bp, Homo sapiens
agttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctattgaaaccatgtttgtagttctgaatacacagggtttgtgtgtatttactctatgtaataaactaatattgcccctagagttaaagag

SEQ ID NO: 45848 - DNA, 283 bp, Homo sapiens
cggtggcgtttccttgaggaagagtgagggttccaacttttctgcttatctgggaggtgttgggcgcggacagtcgagatgtcagagaaaaagcagccggtagacttaggtctgttagaggaagacgacgagttttaagagttcccttccgaagacttggcttgcttagatgaagatgaagatgcacatgtcttggaggataattgggatgatgacaatttcgaggatgacttctctctatcagtgtacgagctcgaactagagaaaacatatgttatataga

SEQ ID NO: 45849 - DNA, 280 bp, Homo sapiens
cataagtacatccaggttgtctaccttcataacaacaatatctctgtagttggatcaagtgacttctgcccacctggacacaacaccaaaaaggcttcttattcgggtgtgagtcttttcagcaacccggtccagtacttgggagatacagccatccaccttcagatgtgtcttgcgttcgctctgccattcaacttcggaaactataagtaattctcaaggaaggcctcatttttataacctggcaaaatcttgttaatgtcacatgctaaaaaatata

SEQ ID NO: 45850 - DNA, 243 bp, Homo sapiens
gagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacaatttctttcatgggcaccaaccttcatttgtatgtgtcccgaatccacagtcgtactgattctaattgggacacagagtcataggtagagaat

SEQ ID NO: 45851 - DNA, 266 bp, Homo sapiens
gtcacctttcagggaccagaagtagggctttgcctaggtaacggggcagagatgtggttcgagattctccccggactctccgtcatgggcgtgtgctttttgattccaggactggctactgcgtacatccacaggttcactaacgggggcaaggaaaaaagggttgctcattttgggtatcactggagtcttatggaaagagataggcgcatctcttgagttgatcgttactatttgtcaaagggtttggagaacattgattaagg

SEQ ID NO: 45852 - DNA, 136 bp, Homo sapiens
tatctgttttggtgttcaacattgttttaaggcatcagatttcaacctatatatatagactagcagagaggggatgaggtctattagtgaattgtaggttgtaaaagctgcaggtttgatcctttgctttattttw

SEQ ID NO: 45853 - DNA, 156 bp, Homo sapiens
ttctgggaagaagatgcatgtggatagggttcctcactagaacagttctggaaaatagcacagttatgtagaagccaagaatttattgaccaagaccaagatattggccccagcctactttatcctggggggcaaccagtcttgggaaggtttgtt

SEQ ID NO: 45854 - DNA, 158 bp, Homo sapiens
gcacttcacttaaggatattttgagatatcctttggagaccttgcttggagagctgacattacaattctacaacaaattgtctcttcaaatacggatggtctggataactctgagaaacacatctagtataactgaataagcagggcatcaaattaac

SEQ ID NO: 45855 - DNA, 189 bp, Homo sapiens
aaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactttttgaaaacttaacgctttttggaagccattt

SEQ ID NO: 45856 - DNA, 109 bp, Homo sapiens
gctgataatgttttgcataaatcggaaaggccaaggggtggaaatgactaggaagcagatttcagcttactgtaaaagagtatctacccttgaaatttgatgccctgta

SEQ ID NO: 45857 - DNA, 224 bp, Homo sapiens
ggagatgtcactttcctggaagatgttttaaatgagattcaattaaggatgctacagaacatggcttcaattaagacaactaaagaactcaagaacccacaagagacttcagaaagggtcgggctcgcagcactcattattcagggcttcaaagggttactcttatcttactacaagttcagcttggatcgtgtttttcagagtcgcggggacaaaagaatttt

SEQ ID NO: 45858 - DNA, 225 bp, Homo sapiens
tcacttcatctcttcactaatggagatagctttacactttctgctttaatagatttaagtggaccccaatatttactaaaattgctagtttacccttcagaagtataatagaaataatctttagttgcccttttctaaccattgtaatttttccctttttccctcccacttttctttaattaataaacccttttttaaagggatttccgtcaagggaaattaaaw

SEQ ID NO: 45859 - DNA, 160 bp, Homo sapiens
  misc_feature 35: n = A,T,C or G
gggtcttgaaaagctggtaggcttatcactcttgncatttagactttgaatattcaaagccggttcctaactgtatatatatatacaccagtataaaaaaaaaatttaaggcagatttgcaaaaagttattttgggcaggtaaaggggggggggcgttct

SEQ ID NO: 45860 - DNA, 171 bp, Homo sapiens
  misc_feature 34: n = A,T,C or G
ggctttcaagggccctccttctgggggcttcgtnccttagccttgctcaggtgcaagtgccccagggggcggggtgcagaagaattccagttttttccaaggcttaaggagaggagaaacttagaaattgaattcttagacctccggagcaggggttttaggccacaacct

SEQ ID NO: 45861 - DNA, 151 bp, Homo sapiens
aattttaagtaggaagtcaccaaacacttctgctttcacttaagtgtctggcccgcaatactgtaggaacaagcatgatcttgttactgtgatattttaaatatccacagtactcactttttccaaatgatcctagtaattgcctagaaag

SEQ ID NO: 45862 - DNA, 157 bp, Homo sapiens
tagatattgaggccaagaatattgcaaatacatgaagcttcatgcacttaaagaagtatttttagaataagaatttgcatacttacctagtgaaacttttctagaattatttttcactctaaggccatgtatggtttctctttgattatttgcacac

SEQ ID NO: 45863 - DNA, 149 bp, Homo sapiens
tgatgcaaacaattactgtcgttgggatttagagtgtattagtcacgcatgtatggggaagtagtctcgggtatgctgttgtgaaattgaaactgtaaaaggaggatgggtgaaaggacctggtattgtgccccttaattgggagagag

SEQ ID NO: 45864 - DNA, 127 bp, Homo sapiens
tcatggcgtgccctctggagaaggccctggatgtgatggtgtccaccttccacaagtactcgggcaaagagggtgacaagttcaagctcaacaagtcagaactaaaggagctgctgacccggaattc

SEQ ID NO: 45865 - DNA, 171 bp, Homo sapiens
gagaaaaagaaggattgatcagagcattgtgcaatacagtttcattaactccttcccccgctcccccaaaaatttgaattttttttttcaacactcttacacctgttatggaaaatgtcaaccctttgtaaggaaaccaaaataaaaattgaaaaataaaacccggggaaa

SEQ ID NO: 45866 - DNA, 164 bp, Homo sapiens
aactcgcccccatctcaggtctcttggctttgcaggcccaccggagaaaactgacgacccgtttctgtaatccttatgggagaccaaccttgtgcctcccgggagatccactcttccacctggaaacgcacgggaagccaagcttccaaaaaagggattgagtg

SEQ ID NO: 45867 - DNA, 147 bp, Homo sapiens
cgctgcattttgacaacatttccaccctggccactcagcacatttcatggaggtcatgtcttttcactgatacttttttgatagtttttatataacaaaatccttattctatttataacttaagatgataaggcactataaatttaa

SEQ ID NO: 45868 - DNA, 177 bp, Homo sapiens
aacgtcatcgtttggaaagcgtcgcaataagacgcacacgttgtgccgccgctgttgctctaaggcctaccaccttcagaagtcgacctgttgcaaatgttgctaccctgccaagcgcaagagaaagtataactggagttcaaggctaaaagacgaaataccaccggaactggtcgg

SEQ ID NO: 45869 - DNA, 150 bp, Homo sapiens
ttgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactaggtattctt

SEQ ID NO: 45870 - DNA, 150 bp, Homo sapiens
tcacataagacgtttattagagtaatgagaagtcagggaaaatcaatggactgggtgtgttttagcaaacaacataatgacatttgaatatttctttgtttaggaaaagtggtttatagaaagaggaccagagttgattaaaaaccattg

SEQ ID NO: 45871 - DNA, 164 bp, Homo sapiens
ctaagttgggattgagtttcaacagcatctctgctgttgacaatggctctctggccaacacggctcatctgagggagcttcacttggacaacaacaagcttaccagagtacctggtgggctggcagagcataagtacatccaggttgtctacccgcataacatc

SEQ ID NO: 45872 - DNA, 224 bp, Homo sapiens
agttctctcaatacataaagaacagcgtaactccagacatggaggagatgtataagaaagctcatgctgctatacgagagaatccagtctatgaaaagaagcccaagaaagaagttaaaaggaagaggtggaaccgtcccaaaatgtcccttgctcagaagaaggatcgggtagctcaaaagaaggcaagcttcctcagagctcaggagcgggcttctgagagc

SEQ ID NO: 45873 - DNA, 219 bp, Homo sapiens
  misc_feature 38: n = A,T,C or G
tttcagtgaaaattttcttccagagtaggttttttttngtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttgagatcactgcagcttctaggacccggtttcttttactgattt

SEQ ID NO: 45874 - DNA, 224 bp, Homo sapiens
tgtaatttaaaaaaaactaaggcagaaggcttttggaagagttagaagaatttggaaggccttaaatatagtagcttagtttgaaaaatgtgaaggactttcgtaacggaagtaattcaagatcaagagtaatttcccaacttaatgttttttgcattggactttgagttaagattattttttaaatcctgaggactagcattaattgacagctgacccaggtg

SEQ ID NO: 45875 - DNA, 681 bp, Homo sapiens
ctgattgggacagccgtgggaaggacagttatgaaacgagtcagctggatgaccagagtgctgaaacccacagccacaagcagtccagattatataagcggaaagctaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactgatgtgtttgataattagtttagtttgtggcttcatggaaactccctgtaaactaaaagcttcagggttatgtctatgttcattctatagaagaaatgcaaactatcactgtattttaataatttgttattctctcatgaatagaaatttatgtagacgcaaacaaaatacttttacccacttaaaaaggagaatataacattttatgtcactataatccttttgttttttaagttagggga

SEQ ID NO: 45876 - DNA, 285 bp, Homo sapiens
agcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactcaaaaaaaaaaaaaaaaaaaaaaaaaa

SEQ ID NO: 45877 - DNA, 670 bp, Homo sapiens
gagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcataaagatctggtacgagtgtgtgaaaacatccccattgtgttgtgtggcaacaaagtggatattaaggacaggaaagtgaaggcgaaatccaattgtcttccaccgaaagaagaatcctcagtactacgacatttctgccaaaagtaactacaactttgaaaagcccttcctctggcttgctaaggaagctcattggagaccctaacttggaatttgttgccatgcctgctccccgccccaccaaaaagttgtcatgggcccagctttggcagcacagtttgagcacgactttaaagggttgctcagacaactg

SEQ ID NO: 45878 - DNA, 428 bp, Homo sapiens
gaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatatatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaa

SEQ ID NO: 45879 - DNA, 168 bp, Homo sapiens
gtgccgtggccattgaaggtgtggcctgcgtgggtgcagtgtaagtgacgctggattgtcaggtggcagcagggggcccctgctgtgtcagtgctaatgaaacatgttgggttggttctaaaataaggccaaacaggccagcacatgccgggggttgggaccttgaaa

SEQ ID NO: 45880 - DNA, 226 bp, Homo sapiens
tgaaatcttcagagaagaatttctctttagttctttgcaagaaggtagagataaagacactttttcaaaaatggcaatggtatcaaaattcctcaagcaggcctggtttattgaaaatgaagagcaggaatatgttcaaactgtgaagtcatccaatggtggtcccggatcagcggtgagcccctatactaccttcaatacatcctcggatgtcgctggcctggca

SEQ ID NO: 45881 - DNA, 222 bp, Homo sapiens
ctactgttggcagtgatcatgatctttggcctactgcaggcccatgggaatttggtgaatttcacagaatgatcaagttgacgacaggaaaggaagccgcactcagattatggcttctacggctgccactgtggcgtgggtggcaaaggatcccccaaggatgcaacggatcgctgctgtgtcactcatgactgttgctacaaacgtctggagaaacgtgga

SEQ ID NO: 45882 - DNA, 157 bp, Homo sapiens
aagtctgactacatccggaagataaatgaactgatgactaaatatgcccccaaggcagccagttcacggacccatttgtagtctggtcaatctctgttgcaccttaggggggaaaaaacagttcaactgctttactctccaaaacaggctgttttgt

SEQ ID NO: 45883 - DNA, 220 bp, Homo sapiens
gattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggtacatagtttctcctctagcc

SEQ ID NO: 45884 - DNA, 221 bp, Homo sapiens
gagtgacgaattaaaaatggtttttaaggatgattgacgattcgaatgaagatttaggggtttggaaatcaaccaaggctatgttgcagcttagctgataaataattttttatgttggttaggagagaaaattaacagttgataatggattggagataggtagtaaaggaaagagcataaaatatttgatagttataggagaatgaagtgaaagtaaggtt

SEQ ID NO: 45885 - DNA, 167 bp, Homo sapiens
tgacaggattattggaaatttgttataatgaatgaaacattttgtcatataagattcatatttacttcttatacatttgataaagtaaggcatggttgtggttaatctggtttatttttgttccacaagttaaataaatcataaaacttgaaaaaaaaaaaaaacaa

SEQ ID NO: 45886 - DNA, 283 bp, Homo sapiens
cggcgctagttcggagtctcccgcgcgcacctcagccgcctcctagcggcgcggcgctcgctcctacgcctaaaatgaccaatgtgtgatttcagttgaataaatagcgtccaaagtcacagatgctatagtctgtgtatcaaaaggagagttggagcatattatcaacacatattggagagctctgttgcacagagagatatcagggggctaaggtatataccacagagcacagcacatgtgagaccagacctcatagatgttgatctcgtgagagggtctg

SEQ ID NO: 45887 - DNA, 143 bp, Homo sapiens
acatgcagcgcaagtaggtctacaagacgctacttcccttatcatagaagagcttatcacctgtcatgatcacgccctcataatcattttccttatctgcttcctagtcccgtatgcccttttgctaacactcacagaaacaa

SEQ ID NO: 45888 - DNA, 186 bp, Homo sapiens
taagtagtaataattataagtacattcttaaagcaaccattgaaatattattacaggcagaccctaatttagatttatattcctgctgcagacattagccttctttgattcttttgccattacatacatgtttcggctacagtcttaacatggactagagctcctgatgggggtgatcccctcaca

SEQ ID NO: 45889 - DNA, 256 bp, Homo sapiens
ggacaaagcatctcattgttttaattataaacaaaaataatgtgggctgagtgcagttgctcaggcctataaccctagcactttgggaggctgagacaggtgaattgcctgagctcgggagttccagaccagcttgggcaacatggcgaaaccccgtctctactaaaaatacaagacattagctgggtattggggtgcacgcctattgtaccagcttcttaggagggctgaggcacgagagatctctttaacccgg

SEQ ID NO: 45890 - DNA, 378 bp, Homo sapiens
agaaggaaaaaagattgaagaaaagtaaacagaatctaagggacttgtgggacaccaccaagtagaccaacatacatattatggaagtctaatcccagaagaagaaggggaaagccaagagaatattcaaagaagtaatggctgaaaacatcccaaacttgatgaaagatatgaatataaacatccaagcagctcggtaaactccaggtgaagataaactctaaagactctacacccagacacattaggatcagactttttgagagacaaagagaaaatcttgagagcagcaagagaggaggggttcatcacatacagagggtctctcaataagactgtcagcacatatctcccgagactctagaggccatgagacag

SEQ ID NO: 45891 - DNA, 287 bp, Homo sapiens
tgagagtggagatctggatgatgatgctgaagctatccttgctgcagacttcgaaattggtcaccttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatttggccttcaggataacct

SEQ ID NO: 45892 - DNA, 160 bp, Homo sapiens
agatattctatgcattttaagcagtatgtttatcttaaagaggctagcatttttcacaaaagatggtgatcccccccacatagtatacattcctctatgcagcaactcgtgtcgcacgtaaactgaacatcctttgtcttttttagcgcggctttctttw

SEQ ID NO: 45893 - DNA, 230 bp, Homo sapiens
aaaagctgagcaaactgaaaactcagcagctcttcttaaacctgcaagagacatgaggtcacaggcaagccactgttccccagataggggtggacaggatgaagtcggagaatcaccatacactcggagcaggaaagctgccaagggaccccccctcgggatttggaaaaccgcacttggaattgacaaatttctgtagttaggtttttgccaatctgtagagttaaacc

SEQ ID NO: 45894 - DNA, 211 bp, Homo sapiens
atcagaactacgcatatacttgcttttaagttatactatacattattcctagtagacagcaagagcaattactactcgttcttgggcagaccttatccaaagtctggtacaactctcctgagactgatgagcaaaggaggagtcaactaatgcgagggatgtataataaatttggacatttaaaaatattttattaataaagggtattgcv

SEQ ID NO: 45895 - DNA, 250 bp, Homo sapiens
  misc_feature 220: n = A,T,C or G
acaactggagtcccgctttgactatttcaaaggttttgctgtctatttgttcccttttgacagactgcaaccctggcggatcctctggttgggaggcatagccactcagtatttgaccaacagagcagaacacgacaggatagccagacagtggaccaagagatacgcaacataattcacataatttgtatgcagtgtgaaggagcagaaggcatcttcntcactgtgctgcaaatctttatagccttta

SEQ ID NO: 45896 - DNA, 253 bp, Homo sapiens
ttctgctgagggggcaggcggactttgagggaaaccgcagataagtttttttctctttgaaagatagagattaatacaactacttaaaaaatatagtcattaggttactaagatattgcttagcgttaagtttttaccgtaattttaatagcttaggattttaggagaaattatgaggactgagagtgtggcatgaggagggaaaaaataaaaggtctctaacacatcccggggttgagatgagcttctccat

SEQ ID NO: 45897 - DNA, 210 bp, Homo sapiens
taaaaagaaaaatagataaggagacatttatgttagacaaaaaggccagaaaatcaggaagaagatgatggaaataatgacaaaagaggtgaagaaaatgatttgaaagaggtggtaattaaattgatttaagaaagatttggaaagagatagagaagggtttaaatatatatatataatttatttttatgtttgagagagaagtgtaaa

SEQ ID NO: 45898 - DNA, 146 bp, Homo sapiens
taagagcactgactgcccccccagaggtcctgacctcaatccccaacaaccacataggtgacatgcaaaccagtctgcacttggggagtccgagtgcactcttcctaggtgtgtgccctgaaggacaaccctcaattgatccttat

SEQ ID NO: 45899 - DNA, 222 bp, Homo sapiens
aaccctctcttttggaaaacataatttgaataaaataatttttaattgattctgaaatttgtcatgttttgaagataactgactccatctaaaagtattgagggcaaagggtcacggaaccttaggttaaaaacttcttaggggcttaagcgctaattaaaaatctctattaaaaattaaaaacacatgagaaaatgagaataatgtgtcatcacataaaga

SEQ ID NO: 45900 - DNA, 201 bp, Homo sapiens
tgacaatagaagctcattagcctcatggtctcgaaaaccccctagaacttcagggccttaaattttcccttcttaacttaaggttggggatacttggttaccttacccaggttcaattggtgcttcaagggttctctatatagggactcggggcacaaacatataggcactcctctgaatattcacagggacactcgtgga

SEQ ID NO: 45901 - DNA, 211 bp, Homo sapiens
accagcctagccaacatggcaaaacactgtctctaccacatataccaaaataagccgggacgtcggcagtacacaacctataagcccactactgggttgtgctgagggcacaagaaatcaattgaaaaatctggaggttgagggttacagcaagaccgcacatgggtgaacatttgcactcacagacctggggtgcacaaagcaagggctc

SEQ ID NO: 45902 - DNA, 224 bp, Homo sapiens
agacttcgctcgtacttgtgcgcctcggtttgcttttcctcgcaaccatgtctgacaaacccgatatggctgagatcggggaattcggtaaggcggaacctgaaggaggcaaggaacggaagggaaaaatcccctgccttccaaaggacggttgacagggggaggaaggacggggaatcgtaataggggtgcgccgccaattttcactgtcacttcccaaagag

SEQ ID NO: 45903 - DNA, 110 bp, Homo sapiens
gtattagagaagctctaaagtttgtaaacgtcatctataagatggagaaatccagaagtaattcttttcaattacaatctattggttttgtcccaattggcttattctct

SEQ ID NO: 45904 - DNA, 221 bp, Homo sapiens
accaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgaggaagacaaactaggagttggaatttacagatttcttaaaaaagaaacaggatgctcttttggggccct

SEQ ID NO: 45905 - DNA, 294 bp, Homo sapiens
taaatataagaactggcctgaatctgtgtatttttcgaagagaggtggcagcattcagcagtatatttataaacaggtacctgtacagaagtgccctggaagaaggcctgctctaaattatccagtgtatggagaatcgacacaggttaggagacgtcgctttgaacgtgctataggaccttctcaaacacacaccatcagacttcaatattcacctccagactagcttatcaagacaaaggtgtccttcataatgaggctaaagtaagtatactgtggagaggactcccaaat

SEQ ID NO: 45906 - DNA, 332 bp, Homo sapiens
agcgacgaactaaaaatggcttttaaggacgattgaagatccgtatgaagacttagggggtcggaaatcaaccaaggctatgttgcagcttagctgataaataattttttatgtcggtaggagagaaaattaacagttgataatggattggagataggtagtaaaggaaagagcataaaatatttgatagttataggagaatgaagtgaaagtaaggttattgagaggtaggtttaacagtcaaccatatatcataagttggaaacatttttgagcctggctagagtatattgataataatagcaaaaaaaaaaaaaaaaaaaaaaaaaaaa

SEQ ID NO: 45907 - DNA, 243 bp, Homo sapiens
agatggtgatggtactataacaacaaaggaattgggaactgtagtgagatctcttgggcagaatcccacagaagcagagttacaggacatgattaatgaagtagatgctgatggtaatggcacaattgacttccctgaatttctgacaatgatggcaagaaaaatgaaggacacagacagtgaagaagaaattagagaagcattccgtgtgtttgataaggatggcaatggctatattagtgc

SEQ ID NO: 45908 - DNA, 475 bp, Homo sapiens
ggggagaaggaactccaaagacattgtcaaccgattctattcagtaccaccttcagatggaggataagaatggacggtttgtatccctatacagaggaccatgtcatacatacaaagtacaaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagctttttaattatatttgaattta

SEQ ID NO: 45909 - DNA, 355 bp, Homo sapiens
gatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactccttatgataccaaaaaaaaaaaaaaaaaaaaaaaaaaaa

SEQ ID NO: 45910 - DNA, 298 bp, Homo sapiens
aaaaataactgattccaatgacattcattttgttttcatgtgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaaccaatgtctgatctcagctgaacaaattagatgtttcagttgctctggggtcactggcttacagatttacatgtgcacacacacacacatttc

SEQ ID NO: 45911 - DNA, 296 bp, Homo sapiens
gaggtggtcgcggcggaggctttggcagctcgggactgagttcaagaatcagcatgattcttcagaggctcttcaggttctcctctgtcattcggtcagccgtctcagtccatttgcggggggtacattggtgttacagcagtggcatttaattaagggacttggatcctatacaggaacctctttgtgggcaaggattagagattacaaatctaagcgacagacatctggagggcctcttgatgctagttcagagtatcagcaagagctggagagggagctttttaagctcaagc

SEQ ID NO: 45912 - DNA, 292 bp, Homo sapiens
ctcggtggtggccactgcgcagaccagacttcgctcgtactcgtgcgcctcgcttcgcttttcctccgcaaccatgtctgacaaacccgatatggctgagatcgagaaattcgataagtcgaaactgaagatgacagagacgcaagagtaaaaatccactgccttccaaagaaacgattgaccaggagaggcaagcaggcgaatcgtaatgaggcgtgcgccgccagatatgcactgtacattccacaggcattgccttcttattttacttctttgagctgtttaactttgt

SEQ ID NO: 45913 - DNA, 292 bp, Homo sapiens
aacgaaggctggaaccaaactacggatgactcgtgctttgacccctacacagtttcctattatgccgttggagatgagtgggcaccgaatgtctgaatcaggctctaaactagttgtgtccagtgtcttaggtcgtgggaagtgggtcaatttcagatgtgattcatcttgtgagtagtaggctttgtccatccactgccatgtttgtctcctcaagttccatgcatgcactcatgtgccaagggagcatgtttggaagacacaggctctcccacacatgacgcacacaaga

SEQ ID NO: 45914 - DNA, 292 bp, Homo sapiens
aatagatatagtaccgcaaggaaagatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaggatttataggtagaggcgacacacctaccgagcctggtgatagctggttgtccacgatagagtctgagttcactttaaatttgcccacagaa

SEQ ID NO: 45915 - DNA, 146 bp, Homo sapiens
atttgagaatttcaagatagtataggaagacaagaacttaaaggtcatctcacttctgctaatattaggtttacgttgttacaggtcagtcaccagaaggccggatacatagtacttgacgcctattgttctttagattgatcccm

SEQ ID NO: 45916 - DNA, 137 bp, Homo sapiens
gacacaaaggaaactaaacagcctttcatagataaattgcggatacagagagtgaaagatatgggtacacagtatatagagaccctcagaaatacattgcttgtggtattaattcacatgtgtgattttagcatatt

SEQ ID NO: 45917 - DNA, 205 bp, Homo sapiens
gagcctctctccctactgctgctacacaagaccctgaggctgacctgcaggacgtaaccatgaagagcctgatccttcttgccatcctggccgccttagcggtagtaactttgtgttatgaatcacatgaaagcatgggatcttatgaacttaatcccttcaataacaggagaaatgcaaataccttcatattccctcagcagag

SEQ ID NO: 45918 - DNA, 235 bp, Homo sapiens
acgcattacgcaacgcagacgaaaatggaagattaattgggagtggtaggatgaaacaatttggagaagatagaagtttgaagtggaaaactggaagacagaagtacgggaaggcgaagaaaagaatagagaagatagggaaattagcagataaatacatacttttagaagagtgaaagataaatttgcaacctcaaaaagtagggagcagagagagacaacagacacagctagg

SEQ ID NO: 45919 - DNA, 169 bp, Homo sapiens
taaagtttcagagaatatgatgaaggcaaagcatgccaaatcagcagtctcctggaggagcagttccagcagggtaagcttctggcgtgcatcgtttaagggccgggtagtttggccgagcagatgactatgtctagaggctaaggaggttggaatctatcttaggaca

SEQ ID NO: 45920 - DNA, 203 bp, Homo sapiens
taaaatttgacatctggataggctggtgttagggttctgtgttttttggggtttggcagagatgctgtttaagctgcctgtggccagaaggcggggggagggggggggttttggtggaaatttttttggttatgatgtctgtctggaaagcggctgttcaggacattcaattggttcatgattatgtcctacatgcattaaaa

SEQ ID NO: 45921 - DNA, 310 bp, Homo sapiens
gatttgggaagagaaagttatcaagagaaagaggtgaggatggaaggatggagaaaaacagactgtgggaaggatcagaagggactccgccgaggcagggatgggttgtgcccatgtgtgccttgacgggacttcatcttatcgactgttaagctgtcacatacaaacaggctttccaccctgctctgrgagcaccacggacagatttccagttcttagtgtggctgtttaaagtagacgatcttggggctggtgaggccactcatgcctgtgacccagggctttagaaggctgaggctaggggattgct

SEQ ID NO: 45922 - DNA, 294 bp, Homo sapiens
cggtggtggccactgcgcagaccagacttcgctcgtactcgtgcgcctcgcttcgcttttcctccgcaaccatgtctgacaaaccgatatggctggaggatcggagaaattcgataagtcggaaacttgaagaagacatgagacgcaagagcaaaaatcccactgcccttccaaagacaccgatttgaacaaggagacgcaagcaggcgaatcgtaatgaggcgtgcgccgccaatatgcactgtacattccacaagcattgccttcttatttgacttctttcagcttgtttaa

SEQ ID NO: 45923 - DNA, 150 bp, Homo sapiens
agtggagagagccagctgagtggttgtctggtcgcgtctcggaaaccggtagcgcttgcagcatggctgaccaactgactgaggggcagattgcagaattcaaggaggcttttccactatttcacaaggatggtgaatggacctatacca

SEQ ID NO: 45924 - DNA, 217 bp, Homo sapiens
tttcacttaagcagcagccatttgcatcacatatagggcacaaggaattcatattttctgccgatctagcactcatttgtactggtcatggacatatggccttgtcaccctcatttaatccttgtcacctctaaatttggggttgcttttttcaccatggaaccccttgttttgcagcgaatgctggtgcagtgcacgtcacatgcttgttcaacct

SEQ ID NO: 45925 - DNA, 147 bp, Homo sapiens
tgctggtcctgtaccagacacattttcttttattgttgcttgctttttaaactttgtttagccacttaaaatctgcttatggcacaatttgcctcagaatccattccaagttgtatatttgttttccaataaaaaacttacaattta

SEQ ID NO: 45926 - DNA, 310 bp, Homo sapiens
tgaagctgacagcattcgggccgagatgtctcgctccgaggccttagctgtgctcgcgctactctctctttctggacctggaggctatccagcgtactccaaagattcaggtttactcacgtcatccagcagagaatggaaagtcaaatttcctgaattgctatgtgtctcggtttcatccatccgacattgaagttgacttactgaaggatggagagagaattgagaaagtagagcatacagacttgtctttcagcaaggactcgtctctctatctcttgtgcgcactgaattcaccccactggagaga

SEQ ID NO: 45927 - DNA, 275 bp, Homo sapiens
ggtggtggccactgcgcagaccagacttcgctcgtactcgtgcgcctcgcttcgcttttcctccgcaaccatgtctcacaaccccgatatggctgagatcgagaaattcgataagtcgaaacttaagaagacagagacgcaagagaaaaatccactgccttccaaagacacgattgaacaggaggagcaagcaggcgaatcgtaatgaggcgtgcgcgccaatactacactatacattccacaagcattgccttcttattttacttctttcagck

SEQ ID NO: 45928 - DNA, 251 bp, Homo sapiens
acaccttgggttttaatttgcaggggagcaacaaactagggaaacatttttcagttattataaagaaggtcagagaccctggcaacatgagaaccctgttttcttaaatacaaaaattagccgagcgtcattgcttcaagtatgtccagctctgggaggctaggtggagtactcacctgaacctgagaagtctaggctgcagtgagccataattataccattgtccccagcgtgggcaacagcagtgagat

SEQ ID NO: 45929 - DNA, 140 bp, Homo sapiens
tccacaggggaagaaagtttggcactgccagctagccacagccatctttaaatattgtttgccttatttatcccgtggatttcaaaggtctaactctaaactcctggtcttcttgatgtggtctaaatctttagcgcggg

SEQ ID NO: 45930 - DNA, 121 bp, Homo sapiens
tcaagacctgcgccttggagccacaatatgacaccctttttcggggtccgggatgtgcgacaagcgccccgaacaagtctgggttttagcccgtcgagaaaccccaggggcaccccaaggg

SEQ ID NO: 45931 - DNA, 176 bp, Homo sapiens
cgagcgcctgatacgcagctaggaatattgataggacccggttcttttttttggtttcggactaggcccgattaagagggacgcccggggcattcgtttttcgccgtagaggggaaattttggaccggcgaagagggcccaaaacgaaagtttttccaagattttttttatttccc

SEQ ID NO: 45932 - DNA, 260 bp, Homo sapiens
atcctattacaattctgtttatattaaatccaaaatatttgattaaattttggaattgtataaatttttaggttaaatccttaaagccaacctatactaaaaattagatccataatcaaaaaatggctcttttgtgtaattgtgtaatttaacctgaatatcataaatgcttacgggccatatagggtgcgggcgctttctccccagggtatgtgtgccccagcgtgagggtggggatatcaaggcgtacgcggggcgta

SEQ ID NO: 45933 - DNA, 201 bp, Homo sapiens
tttgtctgtctcttctgactttttgggaaaagacaaaccagttagctgtggtctggccagcgtgatctcaactgccgaaggactacacgaaggacaagaatccatgattttttgaccaaggccagtaggcttcctatttcagttgattcaccaccaccttcttctaacagcacacacccacttcacgcattctaatatttg

SEQ ID NO: 45934 - DNA, 111 bp, Homo sapiens
aatcataaatatatatatstcthtatatatacatatatgtgtgcctaatttctaaacttgcagctctcacactggggcttctccttagcagggacagatggttctatagag

SEQ ID NO: 45935 - DNA, 202 bp, Homo sapiens
cttagaagagtagcatgaggtaggaaaagataaaaggtttctaaaacatgacggaggttgagatgaaggttcttaatggagtaaaaaatgtatttcccggaaattgagggaagggataaaagggcccggaattaataaccataggaggggaattgtttttggataacattgagggtgctttaacgagttaagggttagagtt

SEQ ID NO: 45936 - DNA, 200 bp, Homo sapiens
ccacctccccaatgctgattgtgtttcatgggaaatattccacaattaaccccctgtggcacataaggcaccttggcttgaattcagatgccagatattcggagcattttcttcaggaaggtaaattacttcacttgaattgaagacataaatccttggacttcccaatgtgtttcacacacgacttttgtggaaagctc

SEQ ID NO: 45937 - DNA, 200 bp, Homo sapiens
acctgcctgtagccccagtgacagctaggatgtgcattctccagccatcaagagactgagtcaaggttgttcccttaagtcagaacagcagacttcagcttttgcattctgattcggatgacatttttcagggattggaatcccttcggttaggcttgacaacttggtggcagggaatttttccttcacacaggcagaga

SEQ ID NO: 45938 - DNA, 118 bp, Homo sapiens
tttctagcctcactgattgtaccatgaagctgacagacctaccagtcaaattcatgtacccagggtaatgggctctcacatgggaacaagagccacagccggttgggggatgtggctc

SEQ ID NO: 45939 - DNA, 111 bp, Homo sapiens
caaaagaaggcaagctttcctcagagctcaggagcgggctgctgagagctaaacccagcaattttctatgattttttcagatatagataataaacttatgaacagcaaaaa

SEQ ID NO: 45940 - DNA, 140 bp, Homo sapiens
cagctctgttctgcccccgctttcctctgtttgatactataaattttctggttcccttggatttagggatagtgtccccctccatgtccaggaaacttgtaaccacccttttctaacagcaataaagaggtgtccctgta

SEQ ID NO: 45941 - DNA, 196 bp, Homo sapiens
atgtacgaactcgtctccaaaggatacttaggttgcaccagtgtatttgtaaaacaggagcaaatttggaccttgccgggccaaagtcgtgtcacgtgggaccttttaatctcagcatcccgagctcccgggagggaaaatttcaagtcaggtagaattctatatataccctttcttttggaccctcagcccttaa

SEQ ID NO: 45942 - DNA, 202 bp, Homo sapiens
ttctgctgagggggcaggcggagtttgaggccaccgcagataagtttttttctctttggcagatagagattaatacaactacttaaaacatatagtcaataggttactaagatattgcttagcgttaaggttttcacgttattttcatagcttcagattttcagagacacatatgaagacttagagagagtagcatatagag

SEQ ID NO: 45943 - DNA, 117 bp, Homo sapiens
tataaaacaattagcagaatagcctacatttgtatttattttctattccatacttctggccacggtgttttctctcaaaatccaattcctttaaaaaataaatctaatgcaggtgtk

SEQ ID NO: 45944 - DNA, 187 bp, Homo sapiens
taacatgttagtgttaggtcaatctgtggtgatggaattgtatttgtgtttgctgcacatgtatatttagtatgtcgggtcttcctatacaatttgggcccacttatggaatttgcgggagggattttcccccctaaaataatataaaccaaggccgccttttgtaaaggtatatatcacggcatat

SEQ ID NO: 45945 - DNA, 182 bp, Homo sapiens
tggtgccagtttggagctcctggaaggtaaagtccttcctggggtggatgctctcagcaatatttagtactttcccgccttttaggtcccgtgcacaggccctaagtcaacctgggattttcttcatcttcacttgggcaataggtaaaaccttccctgtcaaggtttaactagtgtgccaa

SEQ ID NO: 45946 - DNA, 131 bp, Homo sapiens
aaataagaaggaagtggtacttaattgaccagttggagaaaattgagctaattagtgtccttagggtgctttttactgcactgatgaaacaaatgtatttaaaacctcactacttccaatctacaggtagt

SEQ ID NO: 45947 - DNA, 182 bp, Homo sapiens
caccaaagctgcacatgtaaactgacttcttgccaaaggaaatgacccctgggaagttcaagcttctggaagaggctttaacttggacgggcccttcttcaggaaccagttggcagggcagccttcatgcatgtgtaactgtgacctctcagccataagcatgtgtgtcgcagtatttgaag

SEQ ID NO: 45948 - DNA, 135 bp, Homo sapiens
ttacttctacaaacaacagctcagaacttatgtgctgtttgctttgacaatatataggttgtttgaataatcattgtgcatctccattaatgttgttctttgctttgtatataaataacccggggtgacccaaaa

SEQ ID NO: 45949 - DNA, 316 bp, Homo sapiens
atgaaagatgaaatgaatgaaatgaagcgagaagggaagtttagagaaaaacgaatagacagacttgcaccatagcctccgcagacatatggggactatgtgacaagaccaaatctacatctcatttgtgtacctgacagtgacggggtgattggacccatgttggaaaccactctgcaggatattatccaggagaccttccccaatctagcaaggcaggccaaccgttcagattcaggaaatacagagaccgccacatagatactcctcgagaggagcaactccaagacacatagttgtcagattcaccataaaa

SEQ ID NO: 45950 - DNA, 152 bp, Homo sapiens
  misc_feature 79: n = A,T,C or G
tttataggatataatataatattgttcactgaagagctaagtagtatactgagatgccagaatcatctctatatatgcnatatcacatcctctgtgccatgagaatgactgttcctagtattctagcattctgttttctgtgttgagtgttt

SEQ ID NO: 45951 - DNA, 227 bp, Homo sapiens
aattgcttttacatgggccttgtaaaaatgcttgattaaccattccaaaacactgccttatcccagctcaattctcatcttgctttttgagcatattttcagtacattgagaggttttggatcacgattcatcaaatatgtgacttacacttttagttttgtggcatttgcacttaggtcattcacgtctctatgttcatacagatgttcgtcagcacggggccaca

SEQ ID NO: 45952 - DNA, 203 bp, Homo sapiens
gaaacaaaagaacaatacctgttaccacaacatcacacttaagtacctagcccatagaccctataaaggaaccgcagaatagaaactacaaccagctaacaacttcacaataggatcaagacctcctatatcaatataaatctgggatgtaaacagtcttaacacccccacttaaaaggcacagtgaattcaattaattattg

SEQ ID NO: 45953 - DNA, 227 bp, Homo sapiens
aagattgatcgccgttctggtaaaaagctggaagatggccctaaattcttgaagtctggtgatgctgccattgttgatatggttcctggcaagcccatgtgtgttgagagcttctcagactatccacctttgggtcgctttggctgttcgtgatatgagacagacagttgcggtgggtgtcatcaaagcagtggacaagaaggctgctggagctggcaaggtcaccm

SEQ ID NO: 45954 - DNA, 290 bp, Homo sapiens
actgaagcttcagttagaggaggaacgacagaaatgctccaggaatgatggcacagtgggtgacctggcaggactgcagaatggctcagacttgcagttgcatcgaaatgcagagagatgccaatagacaaattagcgaatacaaatttgagctttcaaaagcagaacaggatataactaccttagagcaaagtattagccggcttgagggacaaggttctgagatataaaactgctgctgagaatgctgagaaagttgaggatgaattgtcagcagaaaaacgggagct

SEQ ID NO: 45955 - DNA, 345 bp, Homo sapiens
ttccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgattctttgcaggcttccca

SEQ ID NO: 45956 - DNA, 350 bp, Homo sapiens
agagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttggcagacccagcttagagttcttctttctttcttaagccctttgctctggaggaagttctccagcttcagctcaactcacagcttctccaagcatcaccctgggagtttcctgagggttttctcataaatgcgggctgcacattgcctgttctgcttcggcgtattcaataccgctcagtattt

SEQ ID NO: 45957 - DNA, 419 bp, Homo sapiens
cagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattcgggtgtaacacctacaccattatcttggaaagatacaaccgttggaaacataaccattacagggagctgggacacttaacagatgcaatgtgctactgattgtttcattgcgaatcttttttagcataagatttctactctttttgtttttgtgttttgttctttaaagtcaggtcaatttgtaaaacagcatttctttctgacattagggcccaattaataatcagcaagagtttgatcgtccagttcccacttggaggcctttcatccctaggt

SEQ ID NO: 45958 - DNA, 181 bp, Homo sapiens
tatcacctgttttcttcattccctgatagctatctcatttcactctactgtctcagaattttgttttggcataataggcatgttttgccatttttgagttaccagttttttcctggacaaggctcagggctcagggcttttctttcaagatgggatatttctaggctcgtttctagggtak

SEQ ID NO: 45959 - DNA, 315 bp, Homo sapiens
ttctggagctggagatgaactcggacctcaaggctcagctcagggagctgaatattacggcagctaaggaaattgacgttggggtggtcggaaagctatcataatctttgttcccgttcctcaacctgaaatctttccagaaaatccaagtccggctagtacgcgagttggagaaaaagttcagtgggaggcatgtcgtctttatcgctcagaggagaattctgcctaagccaactcgaaaaagccgtacaaaaaataagcaaaagcgtcccaggagccgtactctgacagctgtccacgatgccatcctggagg

SEQ ID NO: 45960 - DNA, 317 bp, Homo sapiens
aagacccaattacagaatttgttgaatgtttatatgttaactttgactttgatggggctcagaaaaagctgagggaatgtgaatcagtgcttgtgaatgacttcttcttgggggcttgtcttgaggatttcattgaaaatgcccgtctcttcatatttgagactttctgtcgcatccaccagtgtatcagcattaacatgttggcagataaattgaacatgactccagaggaggctgaaaggtggattgtaaatttgattagacatgcaagactggatgccaagacttgattctaaattaggtcatgtgggtatggg

SEQ ID NO: 45961 - DNA, 231 bp, Homo sapiens
tggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagagaggattaagatacactac

SEQ ID NO: 45962 - DNA, 268 bp, Homo sapiens
cgcattttcgtattcttcgcttggcagtgtgtattctttcacaagtttgcctagtgtcttggtttacacaatatgacaactgtgactgtactttagctattgtttgcctgcacatacatgttgtcatatgcacagtgattacgacccttaaggctagggggggcgagttaatttgggtgagtgtgattttgctgattgactgtgagttttcagataggggtctttttctgcgatttgtttgcatttttcagggtgggcaacagtaagg

SEQ ID NO: 45963 - DNA, 282 bp, Homo sapiens
caacatatatgctttcagggtcaaatttgagcaaactgtaaactgtcagggggataaaatgtttctcttgatgtttacatgcacaagctttgcgttctgactataaaacgggtgaacaaatcaatgccagatgcctgttttgcgcagtgtcatgggggtcttagtggacctctctaaatgtggtctggttcacatgctccacgtagctgtgaacttcacatcatcagcttgcagtgtgtgaattgactcaagcattccagtgtcctctatctagagttgccv

SEQ ID NO: 45964 - DNA, 285 bp, Homo sapiens
tgagtttagtgatgaagaagacttcctaaatagcacaaaggctaaacttctgaagttgacaagcagcagcatagaccctggtctgagtatcaagcagttgggtggtttgtatattaattttcatgcagataaactacagtctaacaagagaaccctaacacagatcaaggagaaacagacaaatgagcttctgcagacagccgtcattacacctgattttgaaaaacgcccactgtgttccaccatatagtgaatcactgtatcaacttcagaraacrcgcagag

SEQ ID NO: 45965 - DNA, 240 bp, Homo sapiens
actgaaaaaggacctggtcacccatggaagtggtcaaatggcaaagaatttaacaactggttcaacgttacagggtctgacaagtgtgtttttctgaatccacagaggtcagcagcatggcatgtgagaaggctttatactggatatgtgacatccttacaaatcatacgggtacgtgttcacttattgactattatagactggacctcaagggcaatctgtgtcagtggatgctgctct

SEQ ID NO: 45966 - DNA, 308 bp, Homo sapiens
gaatgctggcttgccggtgctcatgctgtgatccagcactgtgggagaccacggtgggggaatccttgagcccaggagttggagagcaacatcacaacaccccatttctactaataatcaaaaaattggccgggcatggtggcatgtgcctgtagtcccagttacttgggaggctgaggcaggagaatcgcttgagcccaagaggtagaggttgcagtgagccaagatcgcgccactacactccagtctggggcaacagagtcagaccctgtctcaataataataattagtgatgatacttaagtgtd

SEQ ID NO: 45967 - DNA, 724 bp, Homo sapiens
ttgagaatttaaagatagtataggaagacaagaacttaaaggtcatctaacttctgctaatattaggtttaaattgttaaaggtcaaaacaaaaggaaggatacatagtaattgacagatattgttctttagattgaaacaataggattgctaaaatctataaaagttgaattgataaaaatacagcagaagttgtgtttgttacttcagcagtaacctaaatgatatatttgggatccctatgttaatttaatttagaaaagactatccaacagattgtaatatttttattatatcatgatcttgaaaaaaaagatataggaaaaggtttttcattgttttggagcatgtaatcaaattaggttgaaaaactttatgtggcctgttatattaagataagttagcctgccttgcccggaatcaaattcatcttatatttggagataaaattggtttattttacccattggaactctataaaagtagggatgtgggaaccataatttatttaatatggaaaaatattaggcccttaatgggatccaagaaaccccccaaggaataggggattttcttggtggccggctttccctattaccaaatttttttttccccacccttttggcctttttcctcttaaaaaatttcctaaaaatcctatggggcctttttgggttttttttaaaggttgggttttggggaaaaattttttaagaatttttct

SEQ ID NO: 45968 - DNA, 200 bp, Homo sapiens
aaatttgaaatctggttaggctggtgttagggttctttgtttttggggtttggcagagatgtgtttaagtgctgtggccagaagcggggggaggggggggtttggtggaaattttttgttatgatgtctgtgtggaaagcggctgtgcagacattcaattgttattattatgtcctacaagcatttaaaaaaaaaaaaaa

SEQ ID NO: 45969 - DNA, 643 bp, Homo sapiens
tttcacttaaaagcagccatttgatcacatatagagacaagaatgcagatttttttgaagtctaaaaatcattagtactggtaatgagatatttatttttagaatcacttatcctcttgacccttaatttgtggtgctgtttgaccattaaaaaattgtgtgagaggatggtaagtgagataaatattattaacctgaacttgatctttcattagcccctgtggtatgcagtgctactgaagcaaaagatacctgtattagcaggttaatttctgccacagagggagttgctgaaatttacatttgctttgtatttaactgctgtagggagtgactttaaatcctctggctaggaaaagggcagaatattaatattgggtaattatccttcctttatgttcccagaactttggtcctgaaaaagattgaggggccagtgaaaaagggacccctttatggttctctatttgaaaagttataaggcagcattgctctatacattctaggaataaccaactaattcttattaagcctcgaaaatagacttcttaaaggaccggaatggcccgggtaatttatggtgggtggaggtatgacttttaaaaagagctggaaacttctttacatgggaccctgggacctc

SEQ ID NO: 45970 - DNA, 309 bp, Homo sapiens
atcctattaatacacaccttggggtgtattaatttgctaggggagctaacaaaactgagggaaacatgttttccaggttattataaagatattacagagaccctgggcaacatggagaaaccctgtctctactaaaaatacaaaaattagccgagcgtcatggcttgcaagtgtagtcccagctacttgggaggctgaggtgggagaatcacctgaacctgagaagtctaggctgcagtgagccataattgtaccattgtcctccagcctgggcaacaggagtgagatcctgtctcctaaaaaaaaaaa

SEQ ID NO: 45971 - DNA, 319 bp, Homo sapiens
atcacaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatgtccctattgtgacagagccatggtgtgtttgtaataataaaaccaaagaa

SEQ ID NO: 45972 - DNA, 692 bp, Homo sapiens
tacgggaattcggccattatggccggggtcatgacaaggaaacttacaaactgcaacgcaggagaaactatgtaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttacgatcttttcatctcattaattcaattaaaaccattaccttaaaatttttttctttcgaagtgtggtgtcttttatatttgaattagtaactgtatgaagtcatagataatagtacatgtcaccttaggtagtaggaagaaattacaatttctttaaatcatttatctggatttttatgttttattagcattttcaagaagacggattatctagaagaataatcatatatatgcatacgtaaaaatggacacagtgactatttgtagttggtagttgccctgccacctagtttggtagtgcattgggcacacattttaaatttcccccaaattaaaatgtgcaggtattttcagtggtcaaatatatttaactaattagagaaaggattccacccttaaggttttaaaaa

SEQ ID NO: 45973 - DNA, 444 bp, Homo sapiens
attttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaacttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaa

SEQ ID NO: 45974 - DNA, 555 bp, Homo sapiens
gtaaaccatgaagagtttgtacaaatgatgacagcaaagtgacgaccttgtacagaatgtgttaaatttcttgtacaaaattgtttatttgccttttctttgtttgtaacttatctgtaaaaggtttctccctactgtcaaaaaaaatatgcatgtacagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgcctttttttaaagtagttttctttaggaactgtcagcatgttgttgttgaagtgtgggagttgtaactctgcgtggactatggacagtcaacaatatgtacttaaaagttgcactattgcaaaacggggtgtattaaccaggtacccggtacactaattttttgtacggcggggtccgtaccaaaaacaatttcctttaatggtacctgcctttt

SEQ ID NO: 45975 - DNA, 223 bp, Homo sapiens
gtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaaaaaaaaaaaaaaaaaaaaaaaaaaaa

SEQ ID NO: 45976 - DNA, 270 bp, Homo sapiens
accccgaggaaaagaaatcaaccgagattcccccagtagcggcgagcgaacggggaggagcccagagcctgaatcagtgtgtgtgttagtggaagcgtctggaaaggcgtgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggca

SEQ ID NO: 45977 - DNA, 459 bp, Homo sapiens
ctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctaaa

SEQ ID NO: 45978 - DNA, 568 bp, Homo sapiens
gctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaa

SEQ ID NO: 45979 - DNA, 250 bp, Homo sapiens
cgacaagaagaagaaggacgctggatagtcggccaagatagacaaagacccagtgaacaaatccgggggcaaggccaaaaagaagaagtggtccaaaggcaaagttcgggacaagctcaataacttagtcttgtttgacaaagctacctatgataaactctgtaaggaaggtcccaactataaacttataaccccagctgtggtctctgagagactgaagattcgaggctcccttgccagggcagccccc

SEQ ID NO: 45980 - DNA, 255 bp, Homo sapiens
ctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatgggggagacaatcattgaatacaaaacaaataagcc

SEQ ID NO: 45981 - DNA, 247 bp, Homo sapiens
tgtctttggatagaatgggaggcgggtttgccctaggcagttcccagcttgacttttccctttagcttaggtgattttgaggtccccaagatttattttcccttcgtaagggttccaattagattaattattcattgtgtcttttattacacaaataagggacagatttttaagggatcataaacttcatggcttcccttttaggcatatattacataggggctcaactataattttcaaacaattc

SEQ ID NO: 45982 - DNA, 221 bp, Homo sapiens
ttactatatttcctccaagatggagtttaggagacttaaattctgataaatgcttttgtaataaggttagctgtaatacggattctacagtgaatggtgttattcagtagtattattctctgtaagtgaaaactctgcaatctcaggtgctcccgtaattatatggtaaggtatatctcctgttcagaggtataatataggctatagggccctctatatat

SEQ ID NO: 45983 - DNA, 214 bp, Homo sapiens
aagatattctaccatatttctataatagcttattattcatgtgtcttgtctgaaggacactcaaggtacagagcaaaatttctataggttgactagaatgttcataagaatgggcttccaattgcaggcaaggtcatgttctatctgtggacaattactgtcctctaccacaactacgtgccacagttgtgttccacaggtcttataaagggga

SEQ ID NO: 45984 - DNA, 144 bp, Homo sapiens
cacatccgaccttatcagaagcttttagagaagcaaatcttgctgcgtcatttggcaaatcaatcaacttttgaattagaagattatatatgggggccccccaaaatttcccgggagcttttttagaagccacattccccaaca

SEQ ID NO: 45985 - DNA, 109 bp, Homo sapiens
ctctgcctttccagtcggagacctgtgccgcaaacatgctccgcgcagatgcatcggtcaggccaagaagcatccgagcttgatcccccctctttgtgatttattgggg

SEQ ID NO: 45986 - DNA, 261 bp, Homo sapiens
acttcgcatccgcaaactctgtctcaacatctgtgttggggagagtggagacagacttacgcgagcagccaaggggttggagcagcttacagggcagacccctgtgttttccaaagctagatacactttcagatcctttggcatccggggaaatgaaaagatttctgttccactgcacagttcgaggggccaaggcagaagaaatttttgagaagggtctaaaggtgcgggagtattagttaagaaaaaacaacttctcag

SEQ ID NO: 45987 - DNA, 252 bp, Homo sapiens
ggttcattgtgatctagtgagatgtatctgagaattcaaggctgggttaagtattcaaaatttcaatcagtgtcattcactatatttttaggaaatgacgggggaataaaacccatgttcatggcaatggatgttatattaggcctctgcacaaaatgcaacacacatttgtgtatacacacacactggggggctctgggaaatagaggcccctctctctcacaggtctctgtgctcaaagtgttttttata

SEQ ID NO: 45988 - DNA, 181 bp, Homo sapiens
cccacgctcctctcctgactcacgctgttcgctctcgccgaggaacaaggcggtcaggaaggccgcgcgcaacagccatgggctttttaaggataccgaaaacaccctcgggcccggagggggaattgcacccattgcgatgaacctaaaaggcaaaaccgaaatacccggggaaagggtg

SEQ ID NO: 45989 - DNA, 300 bp, Homo sapiens
gaaagatgagacaacagacttaaggactgtagtacacatgcatcataccacatacacattatggtgctgaagagtgataccagagagctacaggggagaggtaaaatgtgaggtatattaggcaaacctttccaaatttgatgaaagtcatgaatctttagatccaggaggctcatcaaactccaagtagagatactcagtcgggcgtggtggcaggtgcctgtattctcagctactcgggaggttgaggcacaagagtcccttgaccttgggaggcagaggttccagtaagctggggtt

SEQ ID NO: 45990 - DNA, 108 bp, Homo sapiens
acaggcggtcatacatgcagggcgggataccataaggaagccaccatggatgaatcccgacataatacgaggggccgataaaaaccgatccattaggaccactcacam

SEQ ID NO: 45991 - DNA, 132 bp, Homo sapiens
gataccagactgagtctattacctgcacatttttgttgttacaggggagtatggtccagtgatgttgccattttgcattgtttcgtttttcactcgggcatttagggcgagggggtgaatgtccattttatt

SEQ ID NO: 45992 - DNA, 220 bp, Homo sapiens
agttacagagtactgtgctgcagagcatagtacatcaggtgtctacctcatacacatatctctgtagttggtcaagtgacttctgcccacctggacacaacaccagcgaggcttcttattcgggtgtgagtcttttcagcaacccggtccagtacttggagatacagccatccaccttcagatgtgtctacgttcgctctgtccattcaactcggggact

SEQ ID NO: 45993 - DNA, 198 bp, Homo sapiens
cagtataatttgacaaagaaaaatgatacttctcttttttttgctgttccaccaaatacaattcaaatgctttttgttttatttttttaccaattccaatttcaaaatgtctcaatggggctataataaataaacttcaacactctttatgataacaaaaaaaaaaaaagaaaaaaaaaaaacacctgttgggtctcc

SEQ ID NO: 45994 - DNA, 247 bp, Homo sapiens
gattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatttaaacaaaccacagcaggatcgaagggtttttagagaatgtgtttcaaaaccatgcctcggtattttcaaccm

SEQ ID NO: 45995 - DNA, 310 bp, Homo sapiens
tgttgaccgggagaaacgagatgggggtgaagctggagatatttcggatgataatctacctcactttccctgtggctatgttctggggtttccaatcaggccgagtggtttgaggacgatgtcatacagcgcaagaggggagctgttgccacctgagaagcttcaagagatagagggaattcaaagagaggttacggaagcggcgcggaggagaagctccttcgcgacgcccagcagaactcctgaggcctccaagtgggagtcctagcccctcccctgatgagatatacatatactcagagcccgttat

SEQ ID NO: 45996 - DNA, 293 bp, Homo sapiens
ttaagattgcttcattaaacatagtcattcaggccgaatgcagtggctcacacctgtaatcccaacactttcggaggccgaggtgggtggatcaccttaggtcaggagttcgagaccagcctgaccaacatggcaaaaccccgtctctactaaaaatacaaaaattagctgggtacggtggtgggcgcctctaattccagctgctggggaggctgaggtgggagaatttctttatcccaggaggcagaggttgcagtgagctgagatcgtgccatttcactccagcctggcca

SEQ ID NO: 45997 - DNA, 344 bp, Homo sapiens
acagtaatcactggtgtcgatattgtcatgaaccatcacctgcaggaaacaagtttcacaaaaggaggctacaagaagtacatcaaagattacatgaaatcaatcaaagggaaacttgaagaacagagaccagaaagagtaaaaccttttatgacaggggctgcagagacacaatcaagcacatccttgctatatttcacacactaccagttctttattggtgagaacatgaatccagatggcatggttgctctcttggactaccgcgagggtggtgtgaccccatatatgagtttctctaagggtggtgtagagatggagaaatgttaacacatgtggcgcta

SEQ ID NO: 45998 - DNA, 562 bp, Homo sapiens
gagtttacacagggagagacaacacagtgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcaaccacgtggtgtggggccttgcaaaaatgacaagccttccttcatcccccccctgaaaagtatccaaacgtgataatccctgaagtagatgtggatgactgtcaggatgttgcctcaaagtgtgaagtcaaatgcatgccaacaatccaattttttaagaaggggacaaaaggtgggtgaattttctggagccaataagggaaagcttgaagccaccaataatgaattaagccaaacatgttttccgaaaatataaccagccaatggctaattaaaacttgtaattttttaatttacaaaaatataaaatatggagacataaacccagttgccaaccgcgtgacaaataaaacaataatgctaacaccttt

SEQ ID NO: 45999 - DNA, 333 bp, Homo sapiens
gatttgaacaattctgagttttccaacttgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtagcaagcaacttagatcagttaacttattctagtagcttttttctagattctttagcattttctatgtagataatcatgtcatctgtgaataaagtattttacttttccaaaaaaa

SEQ ID NO: 46000 - DNA, 530 bp, Homo sapiens
gatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtatttaaaa

SEQ ID NO: 46001 - DNA, 580 bp, Homo sapiens
tggttggggcccggcaaactaccgtgaatgcctatgacctaccacggagagccgacgcgtagcaagtacgatcgcccaataaccccaatattaaaaacgccaacttcgtacaaactaatcgcaacaacaaacaggcgccctcgcacagacagaacgtacagagcattccagcaaactcccgaactataactccccggtcgaaacggaagacctcgccaaacatcccgaacaaatccggggggagggaaacaaaaccgtagaaaatcgtagagtatcaaaatccaaagaagggtcatactcccacttagaaattcgccgtctccccgtatggaacgcccaaacctagagccgggacgggggccggggcgaagtatatccaccactcctagccgtagcgaccctaaacccaggaccccccgccgccggcccgaatcgcttttccaagccctccgccacccttaacccgcctcgtccagctaccatccccaacctcccctccatcaaaaccccacggcggccgggggaagggaagccagtactatcaattcgatagccgccgttaaggaacccgtcccgccca

SEQ ID NO: 46002 - DNA, 129 bp, Homo sapiens
cgttttttgcggaagttataactatatggtgctcatctcaggttggcgttgagtcgatacgtgcaaaatggtggagtgttaattgagggagtaaacggacctcgtactcttgcccacgaaggtatggtg

SEQ ID NO: 46003 - DNA, 277 bp, Homo sapiens
attggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgccccctagagattaagtcagaaatgtactttctggcacataaagaaatcttgaggac

SEQ ID NO: 46004 - DNA, 156 bp, Homo sapiens
ccactgcaggtcctgccagacctccttcctgacctctgaggcaggagaggaataaagacggtccaccctggcaaaaaaaaaaaaaaaaaaaaaaaaaaaaaatggggcccccttggcccaaaaaattttgaaattgggaaaatttaataaatgggc

SEQ ID NO: 46005 - DNA, 104 bp, Homo sapiens
ccttaaattcgtaagttttaaaatctgggccaatgtgttctggtaatcctgattgatgctatctgaataaagttataagctcctatataaaagaaaaaaaaaat

SEQ ID NO: 46006 - DNA, 256 bp, Homo sapiens
ctcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagagacacgtctggctaggagaaactatcaatgctggcagccagtttggatataatgtagaaggagttacttccaaggaaatagctaccc

SEQ ID NO: 46007 - DNA, 157 bp, Homo sapiens
aatgttgtaaaaatagacttttggacacacagctgttggggctgcactgagctgcaatttttaacatggatttataacttaatgtttctgtttataaaatactaatgatttgcaatgtattttactggccaattaaaacagatgttttattctttct

SEQ ID NO: 46008 - DNA, 264 bp, Homo sapiens
atattgagatgctctgggggtgtattgtatacctgccagttttcttcatttctgaattgagttttcttttcttgatgttggtttcctttcatatcacctcaaggtttagatttgtgaaggaataagcatgatggaaataatagtctcgaaaggagatatgttgtatataatcaggaggaagaggagggaggggcttacccattttgatattttgctgtagggcgccatttttgtctctcatagggaaatctaaccacctcccat

SEQ ID NO: 46009 - DNA, 270 bp, Homo sapiens
  misc_feature 241: n = A,T,C or G
caggtgtgtttgaaatcttttaaaatcgtatttaaataaaaatgtggcttccttattggtgtggactcatactttcccagaaaggtttgtatcagtcttttcatggtgactatttaagttacttacttttttctgcagtgattgcttcttaatgctgaaatcagaaagattgtcagcaagaaggagagcaggccaatttttatttctccattggggtaaaggcacagcaattgattagctntggagcttccggtttcaccgtccatgaaa

SEQ ID NO: 46010 - DNA, 142 bp, Homo sapiens
agacagagaaagacctgtgtacaccataaatagatatatatgagggggaatcaagggctcatatttaagggctcttttaaatgggagctcttttttgtgcacggggaacacgtagatgggggtaatggacgttgttgtatct

SEQ ID NO: 46011 - DNA, 114 bp, Homo sapiens
tagacatttatttcctagtaaaaccatttttaaactcggggggcccaaccctttggacacacaaaatttcctaaaatgtaaaattattattcaaaaaccccccttccccgggcc

SEQ ID NO: 46012 - DNA, 130 bp, Homo sapiens
cccagtgcctgtctgtgtgggtgaatgaaagagtcccctggtgcccctgggttgggggtttttcattggggttaaacgttggctttttttgggggggtttggggaatatttttttggggggtgttttaag

SEQ ID NO: 46013 - DNA, 332 bp, Homo sapiens
tcaaggcaagttcgggacaggtcataacttagtcttgtttgacaagctacctcttgataaactctgtaagggaggttcccaactttaaacttttaaccccacgctatggtttttgagagacttaagagttcggggctcccttggccaggggcagccccttcaggaggctcccttagggaaaggggcttttaaaactcgggtttaaaagcacagagctctaagaaaatttttcaccccaaaatatccccgggggggggggggctcccccccctcggtggaggagccccatatatggggcccccccccgcttccctttggggaaaaaaactctt

SEQ ID NO: 46014 - DNA, 205 bp, Homo sapiens
ggcaggaagttggcccggtgtcttggcggatgcggtcgtaaagataggtacttgttttggattaggaaaatttttttttaattacccttttttaaaagaagaatttgcgccattggctttcgggtttttggatggggattagggattcgttttttccacattttaaaaaatattttcaacgcctccataattttttcaaacagaa

SEQ ID NO: 46015 - DNA, 151 bp, Homo sapiens
tctggcagttgaaaatcgtgggaaagagaatttttattggcacttgtatctatgaaataccccaaaaccttacgggttacaaaagttttcctaaccttttgtaatttttcccttttaggcccccccggggaaattctcataggagtgaagg

SEQ ID NO: 46016 - DNA, 109 bp, Homo sapiens
gcattgcttgctctcgtagagttggttataacgtatgtgctataatttctcatgtggcttatttaattaccattttattcgaattaaattggaaaattccatggttaag

SEQ ID NO: 46017 - DNA, 143 bp, Homo sapiens
cattgaacctcaccataactttcctttaggaccatttaaaatctttgattgtgtgccggttaattggtgtttctccacaaatattgggggacctggcttgggcacatttctctctcctcctctttatctctgggggcttttct

SEQ ID NO: 46018 - DNA, 222 bp, Homo sapiens
acctgaagaaagacagcaaacacctgaggtggtaccttatgattcttgaactttctatgatcaggcagttgtcaggtaagaagattttgttcacaggttccggggctgtcataagaacttttcaatgtctgggtctttccccttgttgggggggcaattacatatttttgtggaattcccccaaaataaaaatttctcaaaagggtgggtttgtttctcggg

SEQ ID NO: 46019 - DNA, 255 bp, Homo sapiens
ttgaaaaatgcaattgacataataaagaatgcatcagagtctcttaacatattttgatgagggcaggaggtaagaatttagctttgaaggacagggttattttgaattattacacaaaggggggacaaaagggaaaggggttacaaaaacccttgcgggcccaccctctcacttggggaatttggccccacaagggggcaaatttttttggggtttggggggggttttgagggggggggggggggagatagggct

SEQ ID NO: 46020 - DNA, 112 bp, Homo sapiens
ggttggccttgaatataaaaccaaagggggctgtggccatattcgccgcctagggaggggcccccctttttgtgggggcatatttcgcgggggacgtgatatatcccccccg

SEQ ID NO: 46021 - DNA, 151 bp, Homo sapiens
tgctggtgctgtgcaggacaatggggcaatccacaaatttgtcccttacctgattgctggcatccaacactcatgccaggacattggtggccaagagcttgacccaagcccgagccatgatgtactctggggagcttaagtttgagaagag

SEQ ID NO: 46022 - DNA, 106 bp, Homo sapiens
ggccttagctgtgctcgcgctactctctctttctggcctcggaggctattcccagccgtactcccaaagagcttagggtttactcaccgctcactcccagcagagg

SEQ ID NO: 46023 - DNA, 168 bp, Homo sapiens
ttcaagcacaggtacctgctctgcgaactggtttctgacgacccccgctgccgcctaagcctcgatgaccgagttcttagcagcctcgtacgggacacgatcgccaaggtgcacggaactttcggcgcagcccctggctttcatcggcttggcggttcgatatctcaa

SEQ ID NO: 46024 - DNA, 122 bp, Homo sapiens
tgagtttgtccaaaacattttattttattgacataattttgccataaaaaacgttgtgaacctaaaactgctctggaaaataaagattatttttccccagtcattatctggggtagggaagg

SEQ ID NO: 46025 - DNA, 136 bp, Homo sapiens
ccattttcttcaatttatttcagtttaatggaaaagttgcttagtatttatgaggaaattcttcttcctagcaggtagcttaaagagtggggtatatagagccacaacacatttttattttgctttgcttcagtta

SEQ ID NO: 46026 - DNA, 152 bp, Homo sapiens
aacattaattgactcgctcattggtggagcatgcctcccctgaagggccccagggggaagggtacccaaaggcacaataataactttgggttggatatttttcatgaaccattcacacttccaggaaaaacaagttttcacaaaaaggaggg

SEQ ID NO: 46027 - DNA, 151 bp, Homo sapiens
tttcctggtataatatatgaattgttttctgagaaggaacttttaataggttgaaagggtaacctggttaaaagggataccaaataatgggttaacctggaaaacctgaaaattgggcctagaaaacaatttccttttgttattattttgg

SEQ ID NO: 46028 - DNA, 112 bp, Homo sapiens
cagagaatgggattcagtttgggaacttgtggggatgagagttacaaagttgaacttggaagggggaaaagggagtttggagtcaattggaaaccagaaagcttcccaaggt

SEQ ID NO: 46029 - DNA, 139 bp, Homo sapiens
atgcagttattaaaatgctgttcttctctcctaagttgaaaatcagaaacttgtgggaaagagcactttaatgttgggactctatgtttggtgaagtttgcttttccccataaaacactcagggacaactgacgtcaca

SEQ ID NO: 46030 - DNA, 175 bp, Homo sapiens
cgagatgtctcggtccgtggccttagctgttctcgcgctactctctctttctggcctggaggctatccagcgtactccaaagattcaggtttactcacgtcatccagcagagaatggaaagtcaaatttcctgaattgctatgtgtctgggtttcatccactccgacattggaga

SEQ ID NO: 46031 - DNA, 237 bp, Homo sapiens
  misc_feature 31, 32: n = A,T,C or G
ggatgagatcagatatgaagaggaatgctcnncacctcgtgaatacaagacctgctcaatgttaagatggccttgacatttagattgccacctacaaggaagcttccttggaaggcgaaggagagcaggatttctctgcctcttccaaacttttcctcctgaacctgagggaaactaatcttggatcacttcctccttggcggaaccactcaaaagggcacttcttattaagtcggg

SEQ ID NO: 46032 - DNA, 175 bp, Homo sapiens
ggagcaaacagtctttgaatatcgacacgcaaggctgtgagactacctattgtagatattgcacctatgacattggtggtcctgatcaaggaatttggtttggacgttggcccttgtttgcttttttataaaccaaacttttttttgaattcccaacaaaaaaaatttaactccm

SEQ ID NO: 46033 - DNA, 173 bp, Homo sapiens
tactgaagtctgacctatcccatatagccatgatggggcctgttaaggtagtggtagcagagaattttgatgaatagtgaataatgaaaataaagatgtgctgattgaatttttatgccccctcggggtgggcaatgtaagatccctggagcccaagtttaaaggacttgggs

SEQ ID NO: 46034 - DNA, 159 bp, Homo sapiens
gatctcagaacccatcagagacaacactgaggttaattgccaatgagggcttatgcttagatgtacaggctgacagagaaggttcccgagaggtaaatcatctttccaatccaggggaccaggcatgtctctctgccaagatccatctaaactgggggg

SEQ ID NO: 46035 - DNA, 211 bp, Homo sapiens
  misc_feature 31: n = A,T,C or G
cggctgaccatggagggtgtagaagagaagngaaggaggttcctgctgtgccagaaacccttagagagagcgagggaatttcgcagagctgaagatcaggcgcctcagaaagaaggtttgcccaaaggatgcttcgaaagggcaaggggggaggcttatcttttaaaaggcaaggcgctttccacagggatttatggggcagatgtacaga

SEQ ID NO: 46036 - DNA, 195 bp, Homo sapiens
ttctcttcgttaagtcggccttcccaacatggcgcagtctattaacatcacggagctgaatctgtcgcagctagaaatgctcaagaaccagcctggaccaggaaggtggagttcttgtccacgtccattgctcagctcaaagtggtctagaccaagtatgtggaagccaaggccttttttgaccgtcgtgacaag

SEQ ID NO: 46037 - DNA, 196 bp, Homo sapiens
ttgaggcagccagcgcaggggcttctgctgaggggggcaggcggagtttgagggaaaccgcagataagtttttttctctttgaaagatagagattaatacaactactcaaaaaatatagtcaataggttactaggatattgcttagcgttaaggtttttaacgtaattttaataggctaaggcttttaggagaaaw

SEQ ID NO: 46038 - DNA, 149 bp, Homo sapiens
tggtttaagagtgccaggcgaagggcaaactgtagatcggatctttatgctgttattacaggagaagtgacatactttatatatgtttatattagcaaggtctgtttttaataccatatactttatatttctatacatttatattgctg

SEQ ID NO: 46039 - DNA, 166 bp, Homo sapiens
acagtactacttcctgcctatcctatgattctttttttttttctaaagggaagggtcatgcctgtcaccagaaggggtgcagtggcttgatcataggctcattgcaacccttgccctcctagggtaaggaatcctcccgctttaggccttccctgggggcggggcy

SEQ ID NO: 46040 - DNA, 164 bp, Homo sapiens
ggtgaatctgagaggagaggatggggtaaggcagaagcaccagctgtactactagaagggagctttggtggtagatccctcgtgtctccaacctgactaggtggacagagctcaaagaggccctcttacccctaagcgaggtgataagggcatcttgcttgccm

SEQ ID NO: 46041 - DNA, 106 bp, Homo sapiens
caaagagttggagttctatcttaggaaaatcaaggcccgcaaaggcaaataaatccttgttttgtcttcacccatgtaataaaggtgtttattgttttgttcccac

SEQ ID NO: 46042 - DNA, 217 bp, Homo sapiens
caatacagtttcattaactccttcccccgctcccccaaaaatttgaattttttttcaacactcttacacctgttatgggaaatgtcaacctttgtaagaaaaccaaaataaaaattgaaaaataaaaaccataaacatttgcaacacttgtggcttttgaatatcttccacagagggaagtttaaaacccaaacttacaaaggtttaaactacctaa

SEQ ID NO: 46043 - DNA, 152 bp, Homo sapiens
aagcccctctgcaaaggaactccttctactcccctccagaagaggagaagaggaaacacaagaagaaacgcccggggcagagccccaaattccaccttaaggaagtgaaaagtccaggatgccataaaaacaccacggccctttagtccaag

SEQ ID NO: 46044 - DNA, 310 bp, Homo sapiens
agatattgatcctggcgctatagatatagtaccgtaaggaaagatgaaaattatagccatgcataatatagcagggtctaacccctatacctcctggataatgacttacctagaaacgacctttgcaaggggagccaaagctaagacccccgagaccagacgagctacctaagaccagctaaaggagcacacccgtctatgtagcaaaatagtgggaggattataggtagaggcgacaaacctaccgagcctggtgatagctggttgtccaagatagaatcttagttcacctttaaatttgcccacagar

SEQ ID NO: 46045 - DNA, 212 bp, Homo sapiens
gcacatccttgctaatttcaaaaactaccagttctttattagtgaaaacatgaatccagatggcatggttgctctattggactaccgtgaggatgggtttgaccccatatatgattttgtttagggatggtttagaaatggcaaaattttaacaaatgtgggcagttatttttgatctatcacctgttcatcataactggcttctgcttgtm

SEQ ID NO: 46046 - DNA, 327 bp, Homo sapiens
cgccccccatcaagtcacatagacacgcacacacacacacacacgatcgccatgtgacaatcaaggcagacactggagttgtgcagcttcaagcccaggacccccaaacattcccatgaagcatttagaaactaccagtgaaagtatggccctttttacacctttattacagacttctctcatttaggactgtgagagagtaaatgtctgttggttttaagtctctaagattttgggatatatattatcgcagccctaatacagataaggggagactactatactctccagagatagagcaatatgttccctatcagaatctaagct

SEQ ID NO: 46047 - DNA, 307 bp, Homo sapiens
aaatgtattgattacaaataaacagttgttacttaggaagacctgaaaatatgtctgcaggtttctccttgaagcaaatgtgtgggatcattgcatttccagaaatctgcctccttcaccctccgttgacagtatacgtcatgcctcactttcttctagctgagctttaaatcattagagcttaaattgtcagatcgttcattgcctttccagggttatttagtgaaagtttgttgaaaacaaaaacgcctctttcttggttctgttttcagttattttgaaggtgcagcatactgattaagtgtct

SEQ ID NO: 46048 - DNA, 314 bp, Homo sapiens
tcccgagagtaaatcatctttccaatccagaggaacaagcatgtctctctgccaagatccatctaaactggagtgatgttagcagacccagcttagagttcttctttctttcttaagccctttgctcttgaggagttctccagcttcagctcaactcacagcttctccaagcatcaccctgggagtttcctgagggttttctcataaatgagggctgcacattgcctgttctgcttcgatgtattcaataccgctcagtattttagatgaagtgattctaagaattggtgttgggatcagtaggaaagcatatg

SEQ ID NO: 46049 - DNA, 151 bp, Homo sapiens
agatagcattaggagaaatacctaatgtagatgacagggtgatgggtgcagcaaaccaccatggcacatgtatacttatgtaacavacctgcatgttctgcacatgtaccccagaacttcaattaaaaaaaaaaaaggttgaaaaaaaaaa

SEQ ID NO: 46050 - DNA, 312 bp, Homo sapiens
aacacagaaaaggccaaaagcttaatagaagaaggaggagactgggacaggagaaaccgcctaaaagtgtatcagggtctttatcgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattacaaggagcagagattcttgaagtgttgcacagtcttccagcagttcggcagtatctgttttcact

SEQ ID NO: 46051 - DNA, 289 bp, Homo sapiens
aaattgctgccagtgttttcaatgatggacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatatgactgaacacactcatccatttgtgcttttgtgttgtgattatagggcttaaagtaaagagcccatcctttgcaagtcatccatgttgttacttaagg

SEQ ID NO: 46052 - DNA, 312 bp, Homo sapiens
  misc_feature 37: n = A,T,C or G
caacttggacgctgcagaatggctccgcaaagaaggngtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtcttgggccaaaggaatgaggaatgtgccataccgcaatccgtgtgcggctgtccagaatacgtaatgaggatgaagagt

SEQ ID NO: 46053 - DNA, 226 bp, Homo sapiens
gctgagtttcatatacagcaaagagagaaattgagtctgatcaattcccattgcctctggctgtcacgggatgtcactattgatgactgctctcaagacaagtggcgtgtatcatagctgtcatggttctttggttttagaaggggtccttagagggagtccaataccaccccaccaacactaaacttgcttggctctttcctatacagcacattaataggtctca

SEQ ID NO: 46054 - DNA, 154 bp, Homo sapiens
atttaaactataccttggaaataaatggacttaacagatatatacagaaaagttcatccgacaaccgcagaatacacattctatccaacagtgcatggaactttcttcaaggtaaaccatatgataggccataaaatgagccttaataaatttg

SEQ ID NO: 46055 - DNA, 649 bp, Homo sapiens
ggaaatcgatatacatatcaatgatgatgctgctctaggtatcacaatcaattgtgcttctggttagactgtccccatgtttcctggctccctcagtccaatgctctgccactaaagggaattaattttggttcttaacaaaacatctttttgtttttttctttacagatattgatgatgttaagaagttcaaaccgggttacctggaagctactcttaattggtttagattatataaggtaccagatggaaaaccagaaaaccagtttgcttttaatggagaatcaaaaacaaggcttttgctcttgaagttattaaatccactcatcaatggtggaaagcatgcttatgaagaagtgtaatggaggactataaatgcacaacgtgcagatatctgatagccctttccgtgcactcaagaggaacaagatcattaggtgaatcgggatcatcttcccaaataaagaagtaatgaagaagagcaaggtggcacttccttggcaagggattgaaacatctgaaattctgctgcaagaatccccatctctaaaggactccaagggccaaaaaacaagggggtctatgaaccatttaccggccttcccggtaaaaaccttcaattttttcaaaactttttggagccttggcc

SEQ ID NO: 46056 - DNA, 139 bp, Homo sapiens
agtgggtgcagcacaccagcatggcacatgtatacttatgtaactaacctgcacattgtgcacatgtgccctaaaacttaaagtataattaaaaaaaataaataaataattcaaaaaaaaaaaaaaaaaaaaaaaaaaa

SEQ ID NO: 46057 - DNA, 600 bp, Homo sapiens
gaggcagccagcgcaggggcttctgctgagggggcaggcggatcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggggcttaaacagcttaaaggttagtttaaaaggtgtaggggattaaaataatttgaaggcgacttttaaaaagagattaaaccgaaggtgattaaaagaccttgaaatccatgaccagggagaattgcgtcatttaaagcctagttaccgatttactaacgcagacaaaatggaaagattaattgggaggggaggatgaaccatttgagaagatgaagttgagtggaaa

SEQ ID NO: 46058 - DNA, 501 bp, Homo sapiens
gtaaacagagacgctgcaaattgcttgtggattgtgtaggccgatgcgggccaccatgaaccggggtccggatgactacgacccctacgcggttgaagagcctagcgacgaggagccggctttgagcagctctgaggatgaagtggatgtgctgttacatggaactcctgaccaaaaacgaaaactcatcagagaatgtcttaccggagaaagtgaagcatctagtgaagatgaatttgaaaaggagatgggagctgaattaaattctaccatgaaaacaatggaggacaagttatcctctctgggaactggatcttcctcaggaaatggaaaagttgcaacagctccgcaaggtactacgatgatatatattttgattctgattccgaggatgaagacagagcagtacaggtgccaagaaaaaaaagaagaacacacaggattccacaaatgacgaattactggatgacctgaaaaagataacagagatcaggcctgggt

SEQ ID NO: 46059 - DNA, 227 bp, Homo sapiens
tggccttggaggctatccagcgtactccaaagattcaggtttactcacgtgatccagcagagaatggaaagtcaaatttcctgaattgctatgtgtctgggtttcatccatccgacattgaagttgacttactgaagaatgtagagagaattgaaaaagtggagcattcagacttgtctttcagcaaggactgggctttctatctcttggtactacactgaattcac

SEQ ID NO: 46060 - DNA, 290 bp, Homo sapiens
gtccagccgagcttcccagacatcacatatcactgcaaaaatagcattgcatacatggatcaggccagtggaaatgtaaagaaggccctgaagctgagggggtcaaatgaaggtgaattcaaggcttgaaggaaatagcaaattcacctacacagttctggaggatggttgcaccgaaacacacgggggaatggagcaaaacaagtctttgaatatctgaacacgcaaggctgtgagactacctattggagatattgcaccctatgacattgggggcctgatcaagaatt

SEQ ID NO: 46061 - DNA, 420 bp, Homo sapiens
  misc_feature 38: n = A,T,C or G
ccccatttcagaaccaaaagaaatttggaacaaacttnacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggcacctaaatactcatattctcgagttttatacagttgtatcacatcgaaaagggctttactgttttctgtgtggcatcatgtttaagttgaggaaactcagttcttaaattatctggggaaggggtctggatctctatttttgagattgactttatcacaatatgatcttacatcttataccattacaattgggtttagatcacagagtagaatcgaaactatccaggctat

SEQ ID NO: 46062 - DNA, 300 bp, Homo sapiens
  misc_feature 40: n = A,T,C or G
tgctgagcagaaaacaaaacaggttaagaagagccgggtngcagctgacagaggaagccgctcaaataccttcacaatgaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgt

SEQ ID NO: 46063 - DNA, 350 bp, Homo sapiens
  misc_feature 39, 280: n = A,T,C or G
gaaccttaatatataatgttgccagcgattttagttcantatttgttactgttatctatctgctgtatatggaattcttttaattcaaacgctgaaaacgaatcagcatttagtcttgccaggcacacccaataatcagtcatgtgtaatatgcacaagtttgtttttgtttttgttttttttgttggttggttgtttttttgctttaagttgcatgatctttctgcaggaaatagtcactcatcccactccacataaggggttagtaagagaagtctgnctatctgatgatggataggggggcaaatctttttcccctttctgtaaatagtcatcacatttctatgcca

SEQ ID NO: 46064 - DNA, 278 bp, Homo sapiens
ttaaatacatatggactgttactctcttgcacctaattatcttgatacattcaaatttgtctgggtaaaaaataggtggtagatattgaagccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggc

SEQ ID NO: 46065 - DNA, 310 bp, Homo sapiens
tgaccaccccacccggctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtatcgcaaaagttagaagtcattttacaaattaaaaaaacatttttttcttggaagctttaaaaattaggggattgaaaggatccaggatggctttgtgtgtgtgtctcagattctcatttattagtgagcacacctg

SEQ ID NO: 46066 - DNA, 310 bp, Homo sapiens
  misc_feature 35: n = A,T,C or G
aatcgcggtgcgacgaaggagtaggtggtgggatntcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtggcgcgactgccgctgtgtacagcgcagccatcctggagtacctcaccgcagaggtacttgaactggcaggaa

SEQ ID NO: 46067 - DNA, 229 bp, Homo sapiens
agatgcctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttactgaaaaaaaaat

SEQ ID NO: 46068 - DNA, 225 bp, Homo sapiens
ctggatgagatgaccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaaaaaaaaaaaaaa

SEQ ID NO: 46069 - DNA, 416 bp, Homo sapiens
agagagctgatacttttgagctccaaagaattggattcgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttggccatggggctctggtatagtctttgctatgacttctggccagatgtggaccatatccggggcctccatatgctcataagaacccacacaatggacaagtgagctacattcatgggagcagccagctcagtttggggcaaaatcacacattatctggtactgaagccgctatcaccatggggatggtcttctaaatgaacagcac

SEQ ID NO: 46070 - DNA, 441 bp, Homo sapiens
tgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgtctttcctcacatttggatgattgcataaggtttttaagcatgtcctcctttcttcaccctcccttttttcttctattaatcaagagaacttcaaagttaag

SEQ ID NO: 46071 - DNA, 297 bp, Homo sapiens
cactgtattttaatatttgttattctctcatgaatagaaatttatgtagacgcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaaaaaaa

SEQ ID NO: 46072 - DNA, 187 bp, Homo sapiens
tctctttttttgctgttccaccaaatacaattcaaatgttctttgttttatttttttaccaattccaatttcaaaatgtctcaatggtgctataataaataaacttcaacactctttatgataacaaaaaaaaaaaaaaaaaaaaaaaaaaaaaaaaaaaaaaaaaaaaaaaaaaaaaaaaaaaaaa

SEQ ID NO: 46073 - DNA, 396 bp, Homo sapiens
actctctctttctggctggaggctatccagcgcactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttta

SEQ ID NO: 46074 - DNA, 188 bp, Homo sapiens
ccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagca

SEQ ID NO: 46075 - DNA, 170 bp, Homo sapiens
tggaaacagtataatttgacaaagaaaaatgagatttgtctgtttttgctggccaccaaatacaatttaaatgctttttgtttattttgggaccaattccaacttcaaaatgtctcaatggtgctataataaataaacttcaacactctgtatgaaaaaaaaaaaaaaaa

SEQ ID NO: 46076 - DNA, 110 bp, Homo sapiens
ccgagagcacacatcaggttacgctaggagggggaggctttcagatgacccgaggccaggagacgagactgtccagcatggtgaaaccctgctctactaaaaataccccg

SEQ ID NO: 46077 - DNA, 358 bp, Homo sapiens
actgcctgacattcacttccatagaggacctatcccaaatgtttaattgactgcctatgccaagtccctggaatttgagcttcagtattgtggggctcataaaacatgaaccaagcaatccagcctcatgggaagcctgcacagtttttgtaaagcccttgcacagctggagaaatggcatcattataagctatgagttgaaatggtctgcaaatgtgctcacatctacacgtggcttggaggcttttatggggccctgccaggtagaaaagaaatggtatgtaagagcttagatgtccctattgtgacagagccatggtggggttgtaataataaaacccaggaaccaaaaaaaaaa

SEQ ID NO: 46078 - DNA, 113 bp, Homo sapiens
acgaacggagcccggccgcgataaatgcagggcgagagcgagcgtgtgaagccacagggcgcgacacgagcacgccagcctgggtgacagaagtgagactccagcgcaacgag

SEQ ID NO: 46079 - DNA, 246 bp, Homo sapiens
tgcactgctgcccaaaagacgacactttggtccaaagatctctttcgggattcctggcaacaatcaacgagaatcttcatgtattctggagaacaccattcctgatttcccacaaactgcactacatcagtataactgcatttctagtttctatatagtgcaataagagcataagattctataaattcttacttgctaagacaagtaaatctgtgtaaacaagtagtaataaaaggtaattcaatc

SEQ ID NO: 46080 - DNA, 365 bp, Homo sapiens
ccagtttggggtgtctacttctctgaggaagtattacactagccctgggaaatgcacagaaattgccaaaaggtaaaaggccaaacctcaaagtccacatcaataccacaagtgactccatcctcttgaagttcttgcgccaagtccaaatgtaaagcttgaaggtcttctcctgggatatggcatctatgtatcaccaaaccagtacttccctcttcccgctgaagggaaattcacagaagctatagtttgatgcagagccgaaatatctgataagtgggcgacctgctccacctccaagtcaaaagaagcatgttcaggtaaactcgttctcgcaaaccttttgcggtgggtgggtggactct

SEQ ID NO: 46081 - DNA, 617 bp, Homo sapiens
gaggcattgaggcagccagcgcaggggcttctgctgaggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgaggtgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaactgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtgg

SEQ ID NO: 46082 - DNA, 210 bp, Homo sapiens
gtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagcaaaaaaaaaaaaaaaaaaaaaaaaaaa

SEQ ID NO: 46083 - DNA, 138 bp, Homo sapiens
atattgcaccctatgacattggtggtcctgatcaagaatttggtgtggacgttggccctgtttgctttttataaaccaaactctatctgaaatcccaacaaaaaaaatttaactccatatgtgttcctcttgttctaa

SEQ ID NO: 46084 - DNA, 405 bp, Homo sapiens
aatttaaaataaaaaaagcgtacgggagaaatactggcactggaattaatgaagggcaacttttacttttatgagttttgttatattttaatattgccctctctgttgatgtatgcacctatgtccatccttaataccgtggtcaaaaatcgagaagttagcatcttttgtgttctgagagcgccactcacttctcaccatccagttattattagtggaaatggagaagtgccctagaacttctagtcactctagcatggccctatcaccacatcctgctaatactgacaacctcactacatctgcttgacttttgaccatcagaactaaacacaaagtttcatcacctgtttcatgatcaggtaaaataaaccaaagacgcccggtcaaaactcagaatctaat

SEQ ID NO: 46085 - DNA, 374 bp, Homo sapiens
agacatgtacatacacacacttatacctatataaatttttttgtagttaaatttggtgggtggtatgaagaggctgaatgaatggaaaaacctgcagagaatattcagccggagtgaggaatagggagtgagcacagctgcagaagcaaagggaggaaccgattttaagaaaagcatagtcaacgttatggagtgcttctggagagtgacaagcagataaagactgaaaagcgttcactgaatttcatcttatggagaccagtggacaccttagaaagaactgggcaactaagaaccagagggcaggggaaatgagaaggaaatgctcaactaagaaatgagttggaaagcggctaaatggcaaaaggaaatgg

SEQ ID NO: 46086 - DNA, 246 bp, Homo sapiens
gaatccaaggctgaaggttatagcaaattcacctacacagggctggaggatggcgcacgaaacacactggggaatggagcaaaacagtctttgaatatcgaacacgcaaggctgtgagactacctattgaggatattgcaccctatgacattggggggcctgacaagaatttggtgtggacgttgccctgtttgctttttataaccaaactctatctgaaatcccaacaaaaaaaattaactcata

SEQ ID NO: 46087 - DNA, 278 bp, Homo sapiens
  misc_feature 197: n = A,T,C or G
taccctgtctttacaaaaaatactaaaaaattagctgggcttggcgttgcatgcctgtagacccagctacttaggaggccgaggtgggagatcatctgagcctggaaagtcgaagctgcagtgagccgtgattgcaccactgcactccagcctgggtgacagagtgggaccctgtctcaaaaataaacacataaatnaataaaaattaaaataaattcagtggaaaagttagaagataaatttgagaccatttcccagaaaagtagtataaaaatgac

SEQ ID NO: 46088 - DNA, 280 bp, Homo sapiens
ccaagatgatgtggtgtgatatattaggaaagtctaccatgcgcgaaggacagtgagttgcatgcagcatgtgtgccacgtacttgcaacccttccctaaatattttgggtgagaacagtgagaacaatggaaatagaatagtattggtgatggcctagataaaagaactgatgtaggaaaaaatgggaataataacaggttatgctaaaatatcaacaatggggcaactttgcagctgcagcagtgaatagaaccataggcatgtcattggtatatggc

SEQ ID NO: 46089 - DNA, 290 bp, Homo sapiens
aactgctccatcccgggtccagaagaggagatgaggatcacaaagaagaaacgccgggtgcagagcccaattcctacttcatggatgtgaaatgcccaggatgctataaaatcaccacgggctttagccatgcacaaacgggagttttggggggtgggctgctccactgcctctgccagcctacaggaggaaaagcaaggcttacaagaaggatgtccttcaggaggaagcagcactaaaagcactctgagcaagatgagggggaaaccatctcaataaacacattttgg

SEQ ID NO: 46090 - DNA, 400 bp, Homo sapiens
tgagttcctgctgtggtgagattgttaaaagggtgcaagacctgttgcttctctttttttagatattgttctatctcacacttcatgagggatggaaatacgttacaaagcccgaagtgccgtgcaactcagccatgatgagagtgagtacccctagataaaattaaaaggatttttaaaaagtaattactgcacataaaatgataaatagggaatttgaataatttattgtaagctccttggtaataatttggctatggctcagctataaattcaaatttatacatactatggagattaatatccctgattcaggggagaatccggcagtcacatgatgataatgttttggttacatctttcctgcactggtatttataatttgcctgaaggatggaga

SEQ ID NO: 46091 - DNA, 385 bp, Homo sapiens
caaagcaatttgcagttgctgtaatgacaagattactgcgcaagtgtgaatccaaacagcatagcttttaaattttaaagcatttggtaaattatcgctgagtttttttctgttgccaatagcaaactgcttttccattaatggagaattcatgcctttcaagcattttaaatatgacaatatttataaatgtatgggttggaggaatcgttaaattctctttcctaattttctttcttttgaagatagatctttcaacaaggaatttgtagtaatgactgtgttgacttcaatttgggagcgcagactatgttaaagatgactattggtctcattgaagccacacagacttgctgctgggtttttcttcagggataaataaaaa

SEQ ID NO: 46092 - DNA, 318 bp, Homo sapiens
tgcatactaaaggaccatggtattttttgttactttacgagagggagaagaccgggggccccttttcagctacacttagtcctgagatgtattttttctttaagtctcgaatgaatacaaaaggagcccatcttataatataaaccttgatgtacatgttgagatatttggacaatgaaaatgccttaaaaggaatgcatatggataaagttgcacttataacacccttcaacaaaatctaattttaaattgccctttcttctctattaagggtttctttgtcagggctaccatgggacttataactgttatgaaata

SEQ ID NO: 46093 - DNA, 229 bp, Homo sapiens
cagtgcatggaccccatcatttagagatgctgtttgaatttccatggaaaaaggggccaattttgcaccgggaaaggagctgaagccccagtcaagactttgccatttggggtaatgcagcagattcctgtgctgtatctttccagtgtgtgtgttaatccatagtgcctgagcaccagaagggcatgtaaatctgaagttgtattaaagggttttctatagcaaaaaa

SEQ ID NO: 46094 - DNA, 433 bp, Homo sapiens
ttaatccgcaggaggacggcgagttcaagtgtaggtggcgcaggtcgcaagcgcataacccagcgaaaaaaacaagaacaacttactcctggagtaggctatgtgccgccacctacctaacctacttgacgaaacccagatcttttcatatttctcccaggttggcactgtgacacggttcaggctgccagaaggaaaaggactggaaatagcaaaggctatcattggtggaggttgaggctgaggatggtgccaaaataggtgcggaaacaatgaacaactacctggttggagaaagacccttggagggtcattttatgccacctgaaaaaggacataaaggactctttaaagaccggaatatccatttaagccgccatcatatccatcagggaacggtgtaatcggaaccggacaccaacacaaaagcgac

SEQ ID NO: 46095 - DNA, 120 bp, Homo sapiens
aatacagatgcattaactccttcgcccgcgcccccatttagttgaattcgtgttgcaacactcgtacacgtgttatggaaaatgtcaaccttgggaagaaacccacccaaaaaaaaaaaa

SEQ ID NO: 46096 - DNA, 440 bp, Homo sapiens
tatctggcgcgaggcggaaaggcgcgccagagttggaggtgagaatacttctgcggggcttggataacgccgcaagaccactcttctgaagcagcttgcatctgaagacatcagccacatcacacctacacagggtttcaacatcaaaagtggacaatcacaaggttttaaactgaatgtatgggacattgggggcagaggaaaatcagaccatactggaagaattattttgaaaataccgatattcttatatatggaatcgacagtgcagacagaaaaagatttgaagagacgggtcaggaactagcggaattactggaggaagaaaaactaagtggtgggccagggctcatctttgctaataagcaggattgctcacagcggcccctgctctgaaatgcagaagggctgaacctgcttaccatccgcgacgagctggc

SEQ ID NO: 46097 - DNA, 471 bp, Homo sapiens
gaaggcaagggcgggctgaaaaggttctgttaatagaaagtcaccatgatggggtgggaaagcaaaagttggaaaattcatggccaaacttgctgaacatatgttcccaaagagccaggaataacaccttgattttgtaatttagaagcaacacacattgtaaactattcattttctccaccttggttatatgggaaaggaatcctttcagctgcaggtttgaataatgaatatcatattgtatcatcaatgctgatatttaactgagttgggctttagggttaagatggataaatgaatatcactacttggtctgaaaacatgttgtgcttttatctcgctgctagatggaaatatttgctattcttctgcataagggacagggaccaatcatcatgaggaagctcccttctggcattttcatggattaaattggggggcatcaataaaatggatggaaagctggaaaaa

SEQ ID NO: 46098 - DNA, 166 bp, Homo sapiens
aaggagtggaaacaggtagaatttggcagagaagagacgagatttgtcttgggccgctgagccaccaagaacaagttaaatgcttttagttatatgtggggaccaattccaactccaaaatgtgtcaatggtgctataataaataaacttcaacactctttatgat

SEQ ID NO: 46099 - DNA, 290 bp, Homo sapiens
tccagacaccagccgtctccaccatgccgccgaagttcgaccccaacgagatcaaagtcgtatacctgaggtgcaccgggaggagaagtccggtgccacttctgccctggccccaagatcggcccctggtcttgtctccaaaaaaagctggtgatgacattgccaagcaacgggtgactggtagggcctgaggattacagtgaaactgaccattcagaacagacaggcccagattgaggtggtgccttctgcctcttggctgatcattaaagccctcaaggaaccaccca

SEQ ID NO: 46100 - DNA, 300 bp, Homo sapiens
gatgttgtaggccctgaaggcatggagaaattttgtgaagacattggttgttgaaccagaaaacgtagttatgcttgtcctagcttggaaattggatgcacaaaacatgggttattttactctacaggagtggttaaaaggaatgacttctctccaattttcagctgaactctcatctctcaacactggcaaatattcataagatctaccacacccttaataagctgaacctaacagaagacattggccaagacgatcaccaaacaggaagtctgcggtcttgcagttcttcagactgct

SEQ ID NO: 46101 - DNA, 320 bp, Homo sapiens
atgagactgaaattggtcaagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggcatctgcaaatgatatctaaaccatctggcttggctttattcaactaatgtgaaa

SEQ ID NO: 46102 - DNA, 249 bp, Homo sapiens
aagcctatagtttttggtttttttttaagacggagtcctgctctgtcacccaggctggcatgcaatctcagctcactacagcctcgctcccgggttcaagcggttctccagattcagctactagggagaccgaggtaggagaatcacttgaaccctggaggcggaggttgcagtcagccaagattatgccattgcactccagcctgggcgacgagcaaaactctttctcaaaaaaaaaaaaaaaaaaaa

SEQ ID NO: 46103 - DNA, 300 bp, Homo sapiens
  misc_feature 11: n = A,T,C or G
gaagcaaggtntgaagttcactcttgattgcacccaccctgtagaagatggaatcatggatgctgccaattttgagcagtttttgcaagaaaggatcaaagtgaacggaaaggctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgccgcgtagtttgctaacagcaaagagagttacgaattacgttac

SEQ ID NO: 46104 - DNA, 421 bp, Homo sapiens
  misc_feature 420: n = A,T,C or G
aatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtctctatacttggaacttggtgcatatctaaagaacctaacaacgacatttggggagatgtttttgggttttttataggagagtttagaagacatttgcttaataggaagttttaccataacccagatttattcacgattng

SEQ ID NO: 46105 - DNA, 439 bp, Homo sapiens
atcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgccacaaagaaagtagtagactacacaacagcgaaggaatttggctgattcccttggaattccgtttttggaaaccagtgctaagaatgcaacgaatgtaggaacagtctttcatgacgatggcagctgagattaaaaagcgaatggtcccggagcaccagctggtggtggtgaga

SEQ ID NO: 46106 - DNA, 451 bp, Homo sapiens
  misc_feature 36, 236, 304, 408, 445, 448, 451: n = A,T,C or G
catggaaaaaatactgctggacgcacagcatgagtntggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggncaagtcggccggaaaatattccccccaaggagttcctctttaaacacccgaagcgcacggccaccctnagcatgaggaacacgagcgcatgaagaaagggggcatattctctgcagaatttctgaaagttttccttccatctctgctgctctctcatttgctgccatcggantgggatctatattggaaggcggctgacaacctccacnagnacn

SEQ ID NO: 46107 - DNA, 442 bp, Homo sapiens
  misc_feature 33, 34: n = A,T,C or G
actcgtatataccttcattcatgcttaagttcnngtgcaaggaatgcccgagaaattcccacatctggatagttttctgagtttttcttcatcgcagagtaactatgctgatacagataacacagccttactatgatgcagatgggtttaaaagtttctatatcctttaagagggaaaagagttcttatcactcttaccttcctgtgctacagagaacccagatccagacctagaaatcaggagctgatgttgcctacagattacagagaagccacaagtgagcatgtattcctgtcgtaggaagtatttgatctgtgcagaatgccaagtgcctgcttttacttctcatggccctaggagaatggacagattgggttataatctctgcaggctttgctattcagaaacttggctttccaatgcataaaagagaaataataa

SEQ ID NO: 46108 - DNA, 430 bp, Homo sapiens
  misc_feature 265: n = A,T,C or G
gaggtttgtgcatgttgtcctttttatctgatctgtgattaaagcagtaatattttaagatggacttgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtaccgtactgcatttgccccttgagccaggtggatgtttaccgtggntatataacttcctggctccttcactgaacatgcctaggccaacattttttcccagtgagtcacatcctgggatccagtgtataaatccaatatcatgcttgtgcataattcttccaaaggatcttattttgggaactatatcagtagggacattaccatataatg

SEQ ID NO: 46109 - DNA, 422 bp, Homo sapiens
tttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggccaaagatctctttcgtgattccttgcaacaatcaatgagaatcttcatgtattctggagacaccattcctgatttcccacaaactgcctacatcagtataactgc

SEQ ID NO: 46110 - DNA, 202 bp, Homo sapiens
tttatgtagagatatttctggtccactcaagctcttcgataccaaaatcaggagcatcttgggatttattaaattatgtaagaagatagcacagatatccgggatattattgtgtgaaaatgctgcttttactttgatgtgatctcattgatgtacacaaccaagttccaataaagtgctagaatgtgcaaaaaaaaaaaaa

SEQ ID NO: 46111 - DNA, 290 bp, Homo sapiens
  misc_feature 20, 282: n = A,T,C or G
attgctacggagccagcagngaggcctttcccttcaagggctctgtggtatctctggcacatttgtctaatgtctgaacctctaaatcttttctttttgattggtttactgtttttaagaagccagcactgctgtctcatagatgggatttgtactcttggggcaacttaaagtgctctctcgctgctaacagacgattgatgtcttgtctctgtgacccactcaccatgtaaaggaattaacctcctatcttaacagacatggctcctaatattccctttnttttatta

SEQ ID NO: 46112 - DNA, 310 bp, Homo sapiens
  misc_feature 34, 37, 38: n = A,T,C or G
gaggtggcctaatttggtggccaaagtaactggnttnntttgagtgtaccagcttatggtgccattgatgaggaattaaagtaggtcaaaatttaattggagttggtattacttcgtaaagctagttttcaagaggaagaaaaccacacttactaatgttttctgtatctaatcaaatactcttcatatataattaagcctcatgttatcttttttttaaatcaaccttttgaacttcaactacagtctaaaagtcttgatggtaactatagtgtaattatctttttgtctcactggattttatagttag

SEQ ID NO: 46113 - DNA, 110 bp, Homo sapiens
attgcttgaacctgggaggcaggaggttcgcaagtgagccaagatcacaccgctgcactccagcctgggcgacagagtcatgactctgtctaaaaaaaaaaaaaaaaaaa

SEQ ID NO: 46114 - DNA, 320 bp, Homo sapiens
  misc_feature 154, 315: n = A,T,C or G
gccatgctcaagaatggacttgtaatttgcatcctggagatcaccttactcctggaccagaccaccagccacacatccagattaaaagccaggaagcacagcaaacgtcgagtgagaggagagacgaggtttcgccgtgttagccaggatggtntcgatctcctgacctcgagattcgcagcctcgcctcccaaagtgctggaattacaggcgtgaccaccgcgcccggctagtgcaagggttcctaagtggtatcttttttccttaagaaatactgtccttcttcggtgaaaagattaaatatttctcatgtgnggatg

SEQ ID NO: 46115 - DNA, 234 bp, Homo sapiens
aggtacaactccgaaaggagacattggagaagaaccaagctggcctataaggaattgcacataagatggcacacatatttatgctgctgaaggtcaccgatcatgttaccatatcaagctgaaaatgtcaccactatctggagatttcgacgtgttttcctctctggatctgttatgaacacgttggttgctggattcagtaataaatatgtaaggctttctttttaaaaaaaa

SEQ ID NO: 46116 - DNA, 124 bp, Homo sapiens
tttttgcaaacctcccttggggaataagcctaaccctgagatcttactactggtgggaacattttctgcatttgccaaaaaagtttaggcaaatgaaagctcccaatttaaggtccggaatctc

SEQ ID NO: 46117 - DNA, 432 bp, Homo sapiens
actctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattgggatatcaactgcttgtaaaggtgctcctcttttttcttgtcattgctggcaagattactaatatttgggaggcttaaagacgcatggtatgggtgctaatgacttcctt

SEQ ID NO: 46118 - DNA, 240 bp, Homo sapiens
caactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaaaaaaaaaaaaaaaa

SEQ ID NO: 46119 - DNA, 231 bp, Homo sapiens
tgcacctctcctcaggaccagctgttgctatttcgcattaagactttaaccatatcttagtccaagaactcatcaacctcagcagttgagttgcttggaaatgcccagggtccacacaagttccccaggggaacccaccatgggtctggggactggagtcatgggacaaaaaggggaatggtagaggcagggaacagaaacagggaacggaaacaacagataaaaaaaaaa

SEQ ID NO: 46120 - DNA, 300 bp, Homo sapiens
actcatgctctgttctgttttctcaaagctgaagttggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtg

SEQ ID NO: 46121 - DNA, 145 bp, Homo sapiens
gaaaataaccggagaagacaaggaggtcaaaggatcagggaactaagcattatgtgaattcaccagcaagatgtacagaacgcctgtgtttacattgtttttatggaactagcagaataaaacatctattttaaaaaaaaaaaaa

SEQ ID NO: 46122 - DNA, 135 bp, Homo sapiens
atcatgtcttagagcccgtctttatgtttaaaactaatttcttaaaataaagccttcagtaaatgttcattaccaacttgataaatgctactcataagagctggtttggggctatagcatatgcttttttttttt

SEQ ID NO: 46123 - DNA, 360 bp, Homo sapiens
tatgtggctggatgggccatttagaaactcttaacaggtatggctttcattcctccagttgtttgcttttacagacttggagcaaaaaatatagcaaaaagtaatcatatctggctagatagccatttctctcagattcgttgctataaaaatgaatctactgaggcataaaaatatgaaacatatttaattcatctcttttgcagtttttctgggactccaatagcatttcagtgttatagagagtgacagtgcttgaatgcatgtatatgcacatagtcaattcagagcgtaataactaaaaatcagaatgactggtttttggaaagacttggaaattgggctgctacttaaatattg

SEQ ID NO: 46124 - DNA, 200 bp, Homo sapiens
  misc_feature 9, 16, 39, 46, 53, 54, 58, 59, 75, 85, 109, 115, 121, 132,143, 175, 185, 193: n = A,T,C or G
ccacaggangactgangagcccccaacaacaaaaccacngacggcncggaaanncatnnggacgaaccataaagncaacgggacnggcaccccagaacaatatggaccntatgcnaccacnagaaagaagancaggagggggncccaccctcaacacctgacaaggaaagacaangaagaacagnggaaacangcaaaat

SEQ ID NO: 46125 - DNA, 372 bp, Homo sapiens
agttagttttggcagcccggtcctgatagaggtcaagggtcattgcagagcagggaggagatggtgaagcagactatccagatattcgcgagggtgaagccccctgtccggaagcaccaacaagggatttattccatagatgaagatgaaaaattaatacctagcttggaaatcatcttaccacgtgatttgcagatggtttgtgaataataagcgagaaagctcaaatttaaattcaaagaatttgtgatcaggatgcaaaccaagagaccgtttttgaaaacattgccaaaccagtgctgggagtctgcaggactggatcacccagcagtctgcagttcccaggtcttcaggatgaggtaccagtgcagt

SEQ ID NO: 46126 - DNA, 395 bp, Homo sapiens
tgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtaggtgagaaactgattatgatcacttggaagatttgtatagtttataaaactcagttaaaatgtctggtcaatgacct

SEQ ID NO: 46127 - DNA, 227 bp, Homo sapiens
ttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagtcaaaaaaaaa

SEQ ID NO: 46128 - DNA, 303 bp, Homo sapiens
  misc_feature 49: n = A,T,C or G
atttgatccaacagtggttgtcacaacaaagagatcttggagtcatttncaaaacttttcagctatcttcccatccaatacttggagactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggg

SEQ ID NO: 46129 - DNA, 437 bp, Homo sapiens
  misc_feature 60: n = A,T,C or G
atcacgagaagaaagccatgaccgaccaatatgttgacatactgatcctctactctgagnggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaattcagatgaattattaagcaaacatttaaagtgaattcattattaaaaactattcattttttcctttggccataaatgggtaatgtcattaaaatctaagggcatttcaactgtttaagctggatattt

SEQ ID NO: 46130 - DNA, 500 bp, Homo sapiens
  misc_feature 277: n = A,T,C or G
cgtgaagccccgagggcgaggggaccgaaagcacagtaatcactggggcgatattgcatgaaccatcacctgcaggaaacaagttcacaaaagaagcctacaagaaggacatcaaagattacatgaaatcaatcaaagggaaacttgaagaacagagaccagaaagaggaaaaccttttatgataggggctgcagaacaaatcaagccatccttgctaatttcaaaaactaccagtctttattggggaaaacatgaatccagatggcatgggtgccnattggactaccgggaggatggggggccccatatatgaatttctttaaggatgggttaaaaaaggaaaaatgtaacaaatggggcaaatatttggatctatcacctgcatcataactggttctgcttgcatccacccacaccaggcttaaagacaaatgggactgaggcatcttgagccctcaataatttggacgggaattaattggaggggggcatgggttta

SEQ ID NO: 46131 - DNA, 170 bp, Homo sapiens
gtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaaaaaaaaaaaaaaaa

SEQ ID NO: 46132 - DNA, 364 bp, Homo sapiens
tgaggaagcaggcactcccatacattgtctgtgggaatgtaaattagtggaactgttgctagtctagcagaattacaagtgtacatagcctgttgacccagcaaaattctgcttctaggaattaactctacccactgtaaagtgacaggtgtataaacctaggatcagaagtctaagtgtttctttatcaatcggggactgattaaaatcattgtggcacactcatgtgatggagttcaggtgcaatcattaaaagggagtgagctctatttgtactgatggagaatccttttcaagacaacctggagggagaaagacaaagaagtatgtataatatgcttccatttgtatattaaaaaaaaaa

SEQ ID NO: 46133 - DNA, 309 bp, Homo sapiens
ttgctgcaaacacgcaggggagtagtttattacgagccagaacaaaaaagaaagccatatcttaaagaaacagctttcaagggcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaactgggtcggcttcaataaatct

SEQ ID NO: 46134 - DNA, 153 bp, Homo sapiens
  misc_feature 38: n = A,T,C or G
atgtacagacatacatttatgcacattcacgctgtttntttcatatatacaggcataaaatagagtaaatacagttagttttaaaagtacccttctgtgtgaattgactaccgttgtttgcaaacccgaaaacaaaagacgctcattatgtat

SEQ ID NO: 46135 - DNA, 383 bp, Homo sapiens
aagaaatgggaggcttcaccttaaaaacagtgtgcaaatggcagctagaggttgtgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaaggcacatttagggtttattttttacacttgccaggaaaatagggtaaatcctattagaattttttaaagactttttttaagttcctaaatctgtgtgttattgtgaagtgtataagaaatgactttgaccactttgcaattgtag

SEQ ID NO: 46136 - DNA, 300 bp, Homo sapiens
  misc_feature 53, 242, 253, 298: n = A,T,C or G
ctgaataatatctaaaagactattactgtcaagcttatgtgactaacaaagcnctattgtggtttggatctgatgggaatctgtaaagtagacagaaaagttgtcaaacatagtagttgggtgttttcactaaaaaaaaactatggagagtgctaggttaaaatactaagtgctcaaatatagaatattctctttccatattttctaaaacttgttttatttattatggtataaataaaagntatcaggaggnttttcaatttcaaatttcaaagattgcatcttaatacttgacagnaa

SEQ ID NO: 46137 - DNA, 360 bp, Homo sapiens
gactcagaaaaaatactactctcataaatgggggggagtattttggggacaacctactgtgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatggtagacatgacattctttttctctccttcctgaaaaataaagtgtgggaagag

SEQ ID NO: 46138 - DNA, 178 bp, Homo sapiens
aaaaaaggggaaggaaagcagttgaagagcgaagagcaaagttttggagcagcccgggctacatagcaaattaggggttatcttggactacataaaacccggtgtaaaaaaaaaaaaaaaggaaggagggagggaaggaagaaaaaggagaaagccgaaaaaaagaagggcgggaaga

SEQ ID NO: 46139 - DNA, 306 bp, Homo sapiens
cataaagaagcaaagtgagcactcttgtggataggacttccaaatgagggtacctcagctatatcactgcccaacatcagataacctgacggctatgatgactatgcctcttctaaagatcaatactataacactgatgcgcctagcagaacagcaagagcaattactactcgtccgagcagaccctatccaaagtctggtacaactgccttagactgatgagcaaaggaggagtcaactaatgaagaaatgaataataaatcttgacactgaaaaacattttattaataaagaatatgggcgtgg

SEQ ID NO: 46140 - DNA, 152 bp, Homo sapiens
catgaaaaaacgcacagttatggtacagaaataaaaacgttgccccattaacagaggtcctctggaatgtgttccctacctcacctgatggtatccaccgaagggcaccccactaccattaatggggagaataaaatcctccgtgtcatccc

SEQ ID NO: 46141 - DNA, 131 bp, Homo sapiens
ccaggagctgggtacgtaggcgcattcaccttatgaatatgtatcaagcggtatatgatgtgcgcactgttctgtttgtataattatagctcagtaaaaatgtttactaccccgaaaaaaaaaaaaaaaga

SEQ ID NO: 46142 - DNA, 443 bp, Homo sapiens
ctgcattttctctgtacagtggatgggatttacaacgatcactttcagagagggctgagcggtgaaggaaaaatgagagtagaggaaaactaagaaaacaggaaaatttcaaaaaccaagaaagagacttaaaaaaattccaggtgtgagtttaagaaacactatctcccatggagtaattgcctactttaacatgtctggcagggtgtggacaggcttcagctttcactagaatatgaagcctcatcagatatttactagtttaagcattactaagcaaacatgacatttttgcataggaggattgcttatgcctaattaccaatcttatcaaccatgtgtgaattatcttttccgcctttagggattacttcagacagatttaggcagtaccctgcaagccggagaataagccaaggaaaaaggatccgaaaagaagaaaa

SEQ ID NO: 46143 - DNA, 412 bp, Homo sapiens
atattcacgctagtttgttgcttgcatgaggaaaggtatatatccagtttcacagactggtattgaatattctaatgggaaaagttagaagagtaacaatatgattgctagacagttttgcttactttttagtaccaacaataacagcaatgatgatctcagggtaccttacctttgttataccaaatcaagtcataattctattcataaattttgaagctaagacctagatgctcccttttaggcttgagaaaatatggctacattattggttactatagctggtcttcagctctcttgccctatgcaaagtcacttagaaagcattgattctcagaatatgaataaatgggtgctatcattcatgacatcattgagccaactattactgtaactgagaagctgtgggtta

SEQ ID NO: 46144 - DNA, 430 bp, Homo sapiens
ttaatgtgagatcgacttattaacatggattgggttctattgaatattatcatggttttacaatattttccctagacaccttaaaagaactgaagtacttgagagctagataaggaatagatgagggaagggatgacataagatataccttgattaaatggagagcactgataatgcctattatattatttattaagcccgtttctaagtgccacatctgtattatcccatttgttctctataataatcttatcagatgggtaatgttttttctcattgatgaagagtttgaggccagagaggcaaataaattagcccaagatcgcacctttgttaattgggataagaattcttccagtcttccttcagactgcattatctatatatatcagtataagattatgtaattgagtaatttcgtagaccctga

SEQ ID NO: 46145 - DNA, 370 bp, Homo sapiens
attgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggccagtactgggagatacagccatccaccttcagatgtgtctacgtgcgctctgccattcaactcggaactataagtaattctcaagaaagccctcatttttataacctggaaaaacttgtaa

SEQ ID NO: 46146 - DNA, 435 bp, Homo sapiens
tacgcatagactgttaagataaaaaaataggaatcttgcaaggtaattcttatttgcaagggggatatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtaccgtattacaggctttaggaccagcttgattgttatgcttgcagggtggttttgaaacagaaacaatacttgtttactgtaggaatcctatttatattattttcagtcctgtgaatgctgtgaaaagatttattcctttgaggccaggaagctcccagcatatatgcttctag

SEQ ID NO: 46147 - DNA, 128 bp, Homo sapiens
caaagggcggacgcaagcattagggggctcgaaagaagtttttgacgggggcgcgcaggaggaagagggcggttgagccgggatgcaccattgcgcgctagcctggaccacaggagcgaaactccgga

SEQ ID NO: 46148 - DNA, 376 bp, Homo sapiens
atagttactgaaatgacgagacccttgtttgcacagcattaataagaaccttgataagaaccatattctgttgacagccggctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtggcacatacactaaagccaaacactatgtcagatgggggtaaaatccattaaagaacaggaaaaaataattataagatgataagcaaatgttcagcccaatgcaacccagttaaaaaaaaaattaatg

SEQ ID NO: 46149 - DNA, 501 bp, Homo sapiens
ggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctgggtgtctataagaagctcacgggcaaggatgttaattttgaattcccagagtttcaattgt

SEQ ID NO: 46150 - DNA, 368 bp, Homo sapiens
gataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttgattttcca

SEQ ID NO: 46151 - DNA, 352 bp, Homo sapiens
caggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactcagaagaaaagtcccactgaggaaaagaaagtcttgtgatttttaaaggcaagttttcaagtgctctcatagttctatcctcc

SEQ ID NO: 46152 - DNA, 228 bp, Homo sapiens
ggtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaattcgtcacagaattttgagacccattaaaaaagttaaatcaaaaaaaaaaaaaaaaaaaaaaaaaaaaaa

SEQ ID NO: 46153 - DNA, 620 bp, Homo sapiens
attccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgggacacagagagaagttcaagaagagccaaaattagaaagaagagggcaggttcgtgaagttcgtaaagaagagcaacgttat

SEQ ID NO: 46154 - DNA, 515 bp, Homo sapiens
gctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacttccagtactttggttgacccttgtatgtcacagctctgctctatttattattattttgcaaaataaccattttaacatttgataaagcatatttatgaacatatttcttaataagaaaaatatccattttaataccaatttccaaccttttcaaaatatgcaagtttttacctaaaagtcctaaaataaaagaaataaaatatttgg

SEQ ID NO: 46155 - DNA, 657 bp, Homo sapiens
agatgggaacccaaggttatcgaacagtggaaggttatcattgtgaagaggtagctcaagggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatattatacatgaaaaaataatttgcaaata

SEQ ID NO: 46156 - DNA, 418 bp, Homo sapiens
acaatgattggattagaaactgttgctcacctctctagttgaaacagaaactaggaagctatagttctcacacagtatcatggaaaaaattgtgactttatagactaattccttttaaaacaggatgtggtttttttttgttgttgttgtttttgcaatttatatgtagttttccaactaattaagccaagatcattttaatgagaaatcagagctaaaattgatggattatgtttgtgatgacacaaactagcaaacatgtaagaagccacattggcttattcctccctgcttgaacccctggctctgtaatgaattgcagctctccagaagaatgccttgaggataaaacagaatatagtatatggtcccccatgtttcttgcctgagtcactctattccctaaaacataatgccc

SEQ ID NO: 46157 - DNA, 201 bp, Homo sapiens
aatgttgtttgtacatgtgtgtctgtatgtctctgtggggaggttttatggcttttgtcagattttcaaggccttaacaaagttaaaggaccactgcccagacgtcattgcactgaggccaagttaggatggcatcactctgtggcagctctccctggacttgccctgcctggaacagggtgatttgctggaatggagtta

SEQ ID NO: 46158 - DNA, 180 bp, Homo sapiens
actggggttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctaca

SEQ ID NO: 46159 - DNA, 265 bp, Homo sapiens
gattttattttttaaattatattttatatttattagcacagaagaataatgagagccacattttagttcaacttcttgtgttagctttgatcaaagtcaggacaataatcattgagaaggtgcatgtctaataaaataggtaaatttaataattgtgagacttccagtttttatctccaaggttgtatttagagtggagaaacccaacaactcattacagtttcgctaagatttgaaaggtcaaaaaaaaaaaaaaaaaaaaaaa

SEQ ID NO: 46160 - DNA, 132 bp, Homo sapiens
gttacaaagccctcagagctaaattcttagtggggacacatgtacagtatcagtgtacattcagggttggtgtttctttggctatctgagtaactttgaacattacaaaaaaaaaaaaaaaaaaaaaaaaaa

SEQ ID NO: 46161 - DNA, 538 bp, Homo sapiens
taacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcaaa

SEQ ID NO: 46162 - DNA, 350 bp, Homo sapiens
  misc_feature 302, 304, 310, 311, 314, 315, 318, 319, 340, 346: n = A,T,C or G
aacaaggttataaaggaaccgaagaagtggacaaagactggggcttgaatcaaagatggaggggaaaaaaagatttacgcagggatgtgcaagaatcccacacattatgagtgaaaagaaagacagaaggaggacgtgcgaaacaaagtaagaagaaaatagtaaaacagcataacaaaatcctagtttagactagactaccatttaaaaaacaggtggttatatgaacgcccaaatttgagatgcaatatacctataactaatgaggtaggcacgaggataaatccaagaaactatcaacncnaagccnnccnngcnnatactggaacccaacagcatntaaggncatg

SEQ ID NO: 46163 - DNA, 626 bp, Homo sapiens
atgacatgttggaatgcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagtattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacgaaaaaaaaaaaaaaaaaa

SEQ ID NO: 46164 - DNA, 628 bp, Homo sapiens
agatgggggattactaaatgagaggagccagaaaagagaggaagtcagaaatctgggctcaggggagcagagacaaagaggaggaagagaaagcaaggaagggtccctagcaattgcctagaacaggcatcactgctatttgagactttaaaaaatatgtatccacggttaaagggctggaaactttgctaaaattaccagtgaaggcagtccaggcaggttaatgtgtacaggttaatgtgtgttattgaagcacatgatagactgggtatgtggttctccccaaaggccttggacctagaggtctgagtaatctcagctcactgttagtatcatggccgttctcagctagccataaaggaaattaattaaaaacattggacaccacagttttgggtaaagcaacctcatctttgcccacacagttagagagatgtgagggagaaagggggtctgggggaccagcatttttcctctgctgaaaaggtctcaagaaaaccaccaagatgcaacatcctcacagaaaaagctgcaagcagattctttttatttcccatccctgggcacagagaaaatttaacccccttaaattgggttgtagtttcaaattgcctccaaaaaggttatg

SEQ ID NO: 46165 - DNA, 455 bp, Homo sapiens
tgtctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatgg

SEQ ID NO: 46166 - DNA, 210 bp, Homo sapiens
gtcttaaagtagacttattggtttgttgttgtttatttatctttaaactctgttaatcatttttaattcaattggggaggttttgaaaaagagatcaaacattgctagataagaacataaaagaaaaatacacatttttgcctaaaaccaaggacaaatgactaaagaattaatacgaggaccaaaaaaaaaaaaaaaaaaaaaaaaaaa

SEQ ID NO: 46167 - DNA, 375 bp, Homo sapiens
gagcccatcacagcctaatagaaggcaaccgaaaccatataaaccaagccctactaatcaccattctcttaggattatatttcactatcttacaagcctcagagtatttcgaaacatcattttctatctcagacggaatttacggctcaacattcttcagagcaacgggatttcatggcctccacgtaattattggctcaactttcctaattgtctgtctactacgacaactaaaattccacttcacatcaaaacatcatttcggatttgaagccgcagcatgatactgacacttcgtagatgtagtttgactattcctatacgtttctatctattgatgaggatcctaaaaaaaaaaaaaaaaaaaaaaaaaaa

SEQ ID NO: 46168 - DNA, 370 bp, Homo sapiens
gaggaccccatccagaacatgacagaacatattttcgacgggtccccttatgtccccatgggctgggcagtttctcagactaggctggtctggaatgaccttgagaattatgaggagggctggccaggggtctagtagaacgtacctcagacccaccattttttacccaagatatcctaccagaggacagacctcatgcagtcttcataggcatctcttaactgcacaaccagagaataactatgggacgttgggaaggaggccttcaaatacattcgtttcgccgggaggggctgagccctggggtggcggagaaggcatcagaggagcacaaagtacgatgcaggggagccgtgagatgcagtttgag

SEQ ID NO: 46169 - DNA, 359 bp, Homo sapiens
attctgaggccagtatgatcctgatagcaaaaccagacaaagacatagcaaaaaagaaaagtagggcccaatattcctgatgaatattaatgcaaacatcctcaacaaaatactagcaaactaaattcagcaacacatttaaaagatcattcattatgaccccgtgagatttatcccggggatgcaaagatggttcagtatatgcaaatcaatcaatgtgatacattatgtcaagaaaatgaaggacaaaagcaatgtaatcattttataaatttcaacatttcttcgtgataaacaccctcaaaaaattgggtatagaaggaacaaacctcaaaaaaaaaaaaaaaaaaaaaaaaaaa

SEQ ID NO: 46170 - DNA, 594 bp, Homo sapiens
gcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggacctggattttgtatccccctgtagcagcattactgaaatacataggcttatatacaatgtttctttcccgtatattcccctgtcgggctgcacccctttttcccgcccccaagattgataagtaatgaaagtgcactgcagtgagggtcaaagggggaagtcaacaaaatgtggattgttcc

SEQ ID NO: 46171 - DNA, 641 bp, Homo sapiens
cagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattgggaaatttgttataatgaatgaaacattttgtcatataagattcatatttacttcttatacatttgataaagtaaggcatgggtgtgggtaa

SEQ ID NO: 46172 - DNA, 353 bp, Homo sapiens
gacttctctccagccgagcttcccagaacatcacatatcactgctcaaatagcattgcatacatggatcaggccagtggcaatgtaaagaaggccctgaggctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaa

SEQ ID NO: 46173 - DNA, 534 bp, Homo sapiens
gtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatcc

SEQ ID NO: 46174 - DNA, 423 bp, Homo sapiens
gtcatcgcctctgggtgtgaggatactttggccaccgtccccgagaaataaccgcgcctgcctctcaagataccccatcctctccacgccgctgccgctgccgccatgcatggggaggacgccagatacctcaaaaggaaagttaaaggagggaatatagatgtacatccatcagaaaaagcactcattgttcactatgaagtggaagctaccattcttggggaaatgggggaccccatgttgggagaacgaaaagaatgtcaaaaaatcattcgacttaagagtctcaatgccgacacagatataacttccctggcaaggaaggtggttgaagaatgtaaactcattcatccttcaaaactaaatgaggtagaacagctgttgtactatctacagaaccgccgtgattcattgtcaggaaag

SEQ ID NO: 46175 - DNA, 596 bp, Homo sapiens
gtggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttgg

SEQ ID NO: 46176 - DNA, 182 bp, Homo sapiens
aacactaattaatttagccaagagggctttagtaccccaaacacccactccctcctttggcatagatgaaaaactacaaatcaatttacttgccagcattccagcaagtcatcttcttataaatctttcaagatccttcattccctcataacgaaacaaaaaaaaaaaaaaaaaaaaaaaaa

SEQ ID NO: 46177 - DNA, 514 bp, Homo sapiens
aatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggccgttgtagaaatgtacaaatgcatttccaaactgccttaaacgttgtattttta

SEQ ID NO: 46178 - DNA, 220 bp, Homo sapiens
tggtggcaggtgcctgcaatcccagctactcaggaggctgaggcaggagaatcacctgaacccaggagttcaagactgggcaacacaaagaaaccccatcttttggctgggtgcggtggctcacacctgtaatcccagcactttgggagcccgaagcaggcggatcatgaggtcaggagttcaagaccagcttggccaacgtggtgaaaccccgtctcca

SEQ ID NO: 46179 - DNA, 210 bp, Homo sapiens
aggctgccattgcctgtctgcttcgaagattcaataccgctcaggatttaaatggagggatctaagaattgggttgggatcataggaaagcctatgcagccaacccagatgccaatgttgggaatgatatgacccaaaatttaaggagggaaaggcacccaaacacttctgctttcacttaaggggctggcccgcaatctgtaggaacaa

SEQ ID NO: 46180 - DNA, 521 bp, Homo sapiens
gagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggaccgacagtgaaatctagagtaaaaccaagctggcccaaggtgcctgcaggctgtaatgcagtttaatcagagtgccatttttttttttgggccaaatgattttaattatgggaatgcccaatttttttaatatgcaaataaaaggtttaaaaactt

SEQ ID NO: 46181 - DNA, 752 bp, Homo sapiens
  misc_feature 2, 3, 4, 8, 9, 10, 11, 12, 13, 14, 15, 16, 17, 18, 23, 25,26, 27, 31, 33, 35, 56, 57, 59, 69, 71, 77, 82, 83, 89,90, 92, 107, 120, 122, 153, 210, 217, 225, 226, 251, 263,265, 281, 298, 304, 310, 313, 318, 319, 320, 324, 325, 328: n = A,T,C or G
  misc_feature 329, 332, 334, 347, 352, 353, 356, 357, 358, 364, 367, 375,376, 389, 395, 436, 451, 454, 461, 469, 501, 508, 524, 537,545, 567, 569, 579, 581, 585, 600, 603, 619, 620, 627, 636,637, 641, 645, 670, 678, 689, 698, 702, 721, 726, 729: n = A,T,C or G
  misc_feature 752: n = A,T,C or G
gnnncggnnnnnnnnnnnagggnannntccnangnagggctccggcctaatggggnnanggcctcgagncntgccanccgannacaaanncnatatggtaatagccntttttgagttgcncnagagcccttgagatgcgcgggcctgtcgctngcagagtcccgagagtgaatcatcttgccaatccagaggaacgcagcatgtctctcngccaagncccatccnnactggagtgatgtcatgcagacccngcttaagagacncncttgctgacagacccntaaagctctagggggangtcacnagccanagntggannnacgnnganngcngncctctcccccctngagannctnnngcattnagnttctatcnntccaggcaaaacnaatggngttcttttcatacaaccattttcaaatgaccttagaaaagncttaacatttaaggnatnttatgcncagaatcncttagattgatagggaaagaactcgtaatggngttgggnaaagaaaatgactggnggctaaaccccgnaaaattgngaaaatggtaaaggcagcatgncnaattgggaancnaganatagctaaaattccnatnggctgggggatttgcnntaccaanggagggcannggcnattntttttcccacccggccaaccgggcnggctcggncccttaaaaanccccggaangccncagccctggcttttaccanccccnggngccggtttttaattgcccggacn

SEQ ID NO: 46182 - DNA, 580 bp, Homo sapiens
tttcagtaggatcccttggtacatagaagtcgacctgcaaatagctcttaccacggaaacattcaagctagttgacactgcaatcttttgagccctaccatcatatataacatttattaatactatggtcaaaaaagtataatcaacaagttatgttaacatagagaaatatttgggttcctgtgtggtctgacttttaaatcatcactgaatgtatatgcctgagtatattatgcagccattatctaaaactgcttctcattttattattagtgtaggtatgttttgtgagatggtgataattgttataatccaaaagtaacaatgtctgcattctttatggacatttggggcaatgactgtatatgaacataaaacaatatgtgagtttgtggggtttcctcagaaggaagtcttctaatttagaaacagcaaggggtaggattttatttcagtctcatcaaaaagacacataaacagctagtatgaattgcaataccacaattttaaagcagtcaaggaatcataatatccttaaaactgggggagcagagaaattggaactctggtctatgccgga

SEQ ID NO: 46183 - DNA, 406 bp, Homo sapiens
cagcaactacaaaatattttgtttttctgtctttttcttcagtaaagggtagatgatctgcctttcaggttatctcaaggggcagtttcacctttccataatataaattacccttgtgtaagttatttcttccatcttctgatagcaatttcctgaatgcctgccagctaaccattaagccagtgttcagtattttagcattttaaaaaacaggggaccaatttctgtgtcagcatgggctagcttgccattgaataacaaaggcaaaatctcactgtctcacacaacttttctattgcaacttgcctagggactttggttagatcataggttgccatgatcaaactatggccatggcaaaatctgtctagctccttatttatctaaataaaggtttactggaata

SEQ ID NO: 46184 - DNA, 356 bp, Homo sapiens
agctcagtgttttctaaaaaaagaaactgccacacagcacaaaattgtttactttgttggacaaaccaaatcagttctcaaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgccagtgttgaataaaaaaaaaaaaaaaaaaaaaaaaaa

SEQ ID NO: 46185 - DNA, 613 bp, Homo sapiens
atatgtgaggaggaaaagtttaacatgaaccaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtgggacagtagcacctgtatcattgaactcattttgtatcagagcaattttgcttgcagaaagctatgaaataaaacacgtcccttaactgcattgctatggaattaattttttttccccagggaaaactagtgta

SEQ ID NO: 46186 - DNA, 599 bp, Homo sapiens
gatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtgggtatattgcaaactgcagcttcacatttatggcatttgtcctgttgaaacatcg

SEQ ID NO: 46187 - DNA, 476 bp, Homo sapiens
agactgatgatatcgtgatgtacctaaaagtcagaaaccacattttctcctcagaagtagggaccgctttcttacctgtttaaataaaccaaagtataccgtgtgagccaaacaatctcttttcaaaacagggtgctcctcctggcttctggcttccataagaagaaatggagaaaaatatatatatatatatagtgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcacactattttttaaaaataaatacagttaacatagagtggtttcttcattcatgtgaaaattattagccagcaccagatgcatgagctaactatctctttgagtccctggcctctggtttg

SEQ ID NO: 46188 - DNA, 269 bp, Homo sapiens
ggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttaaaaaaaaaaaaaaaaaaaaaaaaaaaaaaaaaaa

SEQ ID NO: 46189 - DNA, 534 bp, Homo sapiens
gcagagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcc

SEQ ID NO: 46190 - DNA, 510 bp, Homo sapiens
actcgatcagttttcttcatgggacgacacctttgaggaccatttctctgtggctataaaagtgactgaccaatggatgagagactcttgttctgtacatcacaagtgacttgatttttcagcaaaagatatgcttagtttatatcagtagctgaaacacactcagacgcacatacacacatagcacctatttggcagtattctgagaagcttatgtagctgataaagcagtgaaaaaaactcagcctttagatctacatttgtgtgagtccagttgcgtgaaatactgtgatcaaaacaaaaattgcatatttattgcattcaaagggacattttgtagtctaacctgattttcgaaattgattattgataatttaagatatttttcatagttatatgagttacctttagtaatgatagacaataaataaagaactaagaagttgtcatgaaagtcatagccagagcaggtagattagagaaagaaataaagggcatccaaactaagaa

SEQ ID NO: 46191 - DNA, 453 bp, Homo sapiens
gataaacgtgagcaggcagcaggatgctacctgataactgagtataacagcatgcaggggaggactgtgtggctggaggcagctgcggtagaagttggcagtgccactgtggacttttaaagggacaactctgggtacaagcctgaagtgtaaggaggacataaaattaaatacaattgagcttgtctccttgaaaactggttctctccttttactacattaaaaagatcaagtggacagttaagtcattaattcaggtaattccaatcacaaaactacttttttcctgaagtgtcctaatcattgatttttaaaaatgatatttctttcatcataaattatcagcataattgctttggttccatatttcatattaagcttgggctgagtgatgtttaaagcctcctgcttaccttccccccttttcttcctattttattttacttaatacca

SEQ ID NO: 46192 - DNA, 585 bp, Homo sapiens
agatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggatgggaggaaaaagaccacccattttgtagaaggtggagatgctggcaacagggaggaccagatcaacaggcttattagaagaatgaactaaggtgtctaccatgattatttttct

SEQ ID NO: 46193 - DNA, 164 bp, Homo sapiens
tattgaaaacacttactatgcagttgataagaggaatttggtataattatggtgggtgattatttttcatactgtatgtgccaaagctttactactgtggaaagacaactgttttaataaaagatttacattccgcaaaaaaaaaaaaaaaaaaaaaaaaaaaa

SEQ ID NO: 46194 - DNA, 473 bp, Homo sapiens
atctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctag

SEQ ID NO: 46195 - DNA, 578 bp, Homo sapiens
ggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaaggactttatacctcctttactgtaacaagtactcaataaagggaaattgaatggaa

SEQ ID NO: 46196 - DNA, 540 bp, Homo sapiens
caaccagaattctcagagatccatcagagaacaaacactattgttaattgcccaattgagtgcttcatgcctttagatgtacaggctgacagagaagattcccgagagtaaatcatcgtgccaatccagaggaacaagcatgtctctctgccaagatccatctaaactggagtgatgttagcagacccagcttagagctcctctttctttcttaagccctttgctctggaggaagttctccagcttcagctcaactcacagcttctccaagcatcaccctgggagtttcctgagggttttctcataaatgagggctgcacattgcctgttctgcttcgaagtatcaataccgctcagtattttaaatgaagtgatctaagaattggcttgggacaataggaaagcatatgcagccaaccaagatgcaaatgttttgaaatgatatgccaaaattttaaggaggaaagtcacccaaccttctgcttcacttaagtgctggccccaatactggaggaacaagcctgacctggtaccgggaaa

SEQ ID NO: 46197 - DNA, 574 bp, Homo sapiens
atcatttccaaaagaatgtttattgggtgtttactaggtagctttgctggggttacaaaaataaatatgatccagccaggcgcagtggctcatgcctgtaatcccagactttggggaggccaaggcaggtggatcacttgaggtcaggagttcaagtccagcttgtccaacatggtgaaaccccgtctctgctaaaaatataaaaattagctgggcatggtggcatgtgctgtaatcccagctacttgggaggctgaggcacaagaattgcttgaacccgtggggcagaggttgcggtgagttgagatcgcaccactgtactccagcctggcaacagaaagagactccatctcaaaaaaaataaataaataagatccattcacacaaaggatgactatttcaatcctagcaagagctcattaaatggtaacaaatcttcttcttctggaaatggctcttcctaaaacaaatagttcaaggaccacaggcttaagaaataaatctgagtgcattctaatggaaggaaataggttttatgcaaatcatatgcataagtaaacacaagttcccagaa

SEQ ID NO: 46198 - DNA, 655 bp, Homo sapiens
atacagacctagtcaaaggatgtgattgtttgctaacataattgtcaagtaatatatattatctgtgtaatgctcatctaaatatcattgctctttctgaccagtctgaacttgttgccggagggttaaaaatcatgactacttcacgtgtagcagttttcacttgcattcaatgctttgtaaaatagattccaactagtcagtttctataaggcgaacccttcaaatatactccttgaaaagaacagttcaccggacattatgaagttagcactaatgtttgtggggcaggaaaagctgttgtagtgtggaacaatgaattaagaatcagaaagcctgatgtcgggttctagctgtagcataaatgcacttgaccttgatcgctgctctctaatctctggtccttagtttactttagaatgcgtgagttggaggatctccagtatctcttccaggatgaaaaagtaaaggattctggtgaggcctcatggttgcaaaacatgagagtgaatatacttagatatatagagaagttcatagtggatagatatacttggattttaaattctaatgccttactcaatgtcttacctttttcattcaataaatatgaatatactactatatgggaaaaaaaaaaaaaaaaaaaaaaaaa

SEQ ID NO: 46199 - DNA, 252 bp, Homo sapiens
atgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtaaaaaaaaaaaaaaaaaaaaaaaaaa

SEQ ID NO: 46200 - DNA, 585 bp, Homo sapiens
gtacttaaagactgtcctggatctgttgctcgattatatatcttaaacacacaaactataaaatggctgtgtatacatgaaactcacagcttgcattataatgcagaggcttaaatttgccatcacatggatgtttttcatatcatactttaaaaaaacacatggatagtttaccctaataaatatttgggggtaccttgagaaatgtaaatggaacagctccatttcaacttctcatataaagagttcagaatattctgtttatgggcttagtagctttgtttaatatagtgattgtgtatttcagaccaagaacaatgagataaatcctgtttgcacatcatttccaactgcgtcactcttccttgtctacattctgaagaaatcgcactgaaaacatgtctaaatattcatactctttttgagcttaaatttcagtggccaatttcatactatattggaaagttctgtctaataagagcctgacctgtgtatcctgtatagattttcgccagcagagggtattgtcctgagtgccagcattttgggggatggtgaactgtatcagctgagagctatagtcta

SEQ ID NO: 46201 - DNA, 216 bp, Homo sapiens
atccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcaaaaaagaaaaaaaaaaaaaaaa

SEQ ID NO: 46202 - DNA, 321 bp, Homo sapiens
gcttttacctcgttgcactgctgagagcaagatgggtcaccaagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttcaaaaaaaaaaaaaaaaaaaaaaaa

SEQ ID NO: 46203 - DNA, 650 bp, Homo sapiens
gtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagcgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgacccagctgtggacattggaaggcgaaggaagggaggtggctcctgggtcatctttcacaaggctcaagacttcaacctgcagatgtatcttttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcac

SEQ ID NO: 46204 - DNA, 612 bp, Homo sapiens
atccacaaaacttgtgagctgaaccagaagcctctgtttaccaaagtacaagactgtataatatcattttttgtattcactttatctctggagtatcagtttggttatgtggctacatgtaaccaaaaaaaccaaataggagatgcgtttttctaatatcttgatttcagggagtttgtggttgctattgttaacatctttatagctcaggggatccaggctcaaggtctctaaaaacgcgttggtattttctttatgatcttaagatgactgttccaactctagccatcctgcctttgtttgcaaaaggaaggaggaaagaaaagaacgaaagaaatatggttggccctttgaacagctgtttcaggcgcctattatttcacataaaactcttcaaaacttagtagctaaaaacatttatcatcatattttattctgtgtattgacaaagcttaactggcttcctcacttgggatctctcatctgattacagtcagattgtgtctgggactggaatcatctaaatattcagctgggttggaagtccaagatgactcactcttgtggctgagagttgatattagctgttggctgggagctcagctgaaatgc

SEQ ID NO: 46205 - DNA, 295 bp, Homo sapiens
ggcattgaggcagccagcgcaggggcttctgctgagggggcaggcggggcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgt

SEQ ID NO: 46206 - DNA, 539 bp, Homo sapiens
ggcaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttgggtgtttttgtatttccacctcacccccagcacatagcccagtctcttgcacaaaattaagtacttaatgtgtgttgagctaaattgaataaaggattattagcattagcatattttgtgccttggttgtataagctgg

SEQ ID NO: 46207 - DNA, 229 bp, Homo sapiens
gtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacatacgtcctcaaaaaaaaaaaaaaaaaa

SEQ ID NO: 46208 - DNA, 234 bp, Homo sapiens
aagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccagaaatttgtcacagaattttgagacccattaaaaaagttaaataaaaaaaaaaaaaaaaaaaaaaaaaaaa

SEQ ID NO: 46209 - DNA, 634 bp, Homo sapiens
aacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaacctcgaaaactattacctggaggtcaatcaacttgagaagtttgacataaagagcttctgcaagatcctggggccattatcctactccaagatcaagcatttgcgtttggatggaatcgcatctcagaaaccagtcttccaccggatatgtatgaatgtctacgtgttgctaacgaagtcactct

SEQ ID NO: 46210 - DNA, 413 bp, Homo sapiens
tagaactagagaacaaaaacattgcagaaataaactgaatttattggcatgtttgagacagcgtagtaatggtaaaattaaagacacaaacattgtcaaagttttccttcaaattaatataatgaaattgctggctatcacttttaaggtcattaacgtgttcagaaatgagttcaaaaccgattaaaactgtttgtgatgcctgcttaattactctgtctttgaataattctaatggtgggaatttcttttgatttctttctgtttacctcaaattgcacatctcaacactaattgcagtcagtgtttaaaagctggtaagaaaagaaaatagttttagcatataatgttaggaagttagaatagtgtagggtagtcattaacatcaccttccataccaacacgtgcaccta

SEQ ID NO: 46211 - DNA, 510 bp, Homo sapiens
attctctgagagcaaagaagtatttttagaaggtatattgtgttaaggatatggaattttgttttctgaaggtattttaaaatagtattttagattaccccatagctgtgattttgtgtgaaatgagggatgatctttaaaatttccttctacttgtaaatctatggctactttgctttttagctcataggtaaaaaagaaagtagcatatttttattttgacctagctgaaataatgggattgaatgagtagaagtcaggtttactacatgacattgtcaaaaagttatttaaaatttgagtcttggctcctggatataaaaagaggatattatttttttacttcttaggttcgaaaacatttagtttaaacatatccaagatcaagcagtcaaaatgaagttataagtgtgaatttcaagtcattaataagttaattttgaaagaataaaatacctaggaatacagttaccttaaccaaggagattaaaggtctctacaatgagaagt

SEQ ID NO: 46212 - DNA, 225 bp, Homo sapiens
tcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaaaaaaaaaaaaaaaaaaaaaaaaaaaaaaaaaaaaaaaaaaaaaaaaaaaaaaaaaaaaaaa

SEQ ID NO: 46213 - DNA, 376 bp, Homo sapiens
atggtaacaatttatatcagacagttgtactttttgataacttagggaaaacagaaatgacttgaacaagggattgcctgcctcactgcattgcagagatacaatttctgtaaagaacacaaatagcagttgtgaatattaaggtgtgattatctttcactgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagtttttttttcc

SEQ ID NO: 46214 - DNA, 560 bp, Homo sapiens
agacataccaaactgcaaataggattatttttcaaaactatatggtgaaacatatggtgatatgatagacttatggtttttctgtttgctgggattgggtctgctttttgcctatgtgtaaggcattttaatcattgtgaatataatagattccttaaaataagaaaattaaaaatcagaaacttcccttggagtagagacatttcagttgcaagcataaagatttttaaatatataacactaggttatataattcatatatgtgtggttttgtattaataatcaaattaataaaaacatttcattttctaccattgtatgaacgtaattttattttttaataaccacactcatagatggttttgattgttccagttgagtgattgtgtatgtacgcataggaatgttttgttcagttgtactttgtatttccaataatcagaaatcttacctttatgtataaaaacccattatgtaatgtaaaatgtataatattgtcataatattcagaatacaattatttggtaaattagcttgtattttaatgtccagttgcagta

SEQ ID NO: 46215 - DNA, 633 bp, Homo sapiens
tgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgcaatggctctctggcacacgcctcatctgagggagcttcacttgacaacaacaagcttccagaagacctggtgggctggcagagcataagtacatccaggtggctaccttcataacaacaatatcttgtagttggacaagtgacttttggccacctggacacacacccaaaaggcttcttattccggtgtgagcttttcaagaaacccggtccaatacctggggagaaacaggcctt

SEQ ID NO: 46216 - DNA, 452 bp, Homo sapiens
acagtgaactgaagctttaagtctcatccagcattctaatgccatgttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctggatatgttatgtaatttattttaggctataatacatttcctattttcgcattttcaataaaatgtctc

SEQ ID NO: 46217 - DNA, 196 bp, Homo sapiens
tggcaccgatagggttgccagtgaatcttcaatttgtaaaaaacacaatacctgcgaagcataataaagtgaaatgcaataaaacaaggtatacctgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 46218 - DNA, 660 bp, Homo sapiens
gttttaggatccaatgtaaatttaccaggtacacaaagaaacaggaaaagttgacccataatgggaaaaatcagtttattgaaaccagttcagaaatgacagtgctgatatactaataaagtaggtgtttaaaaatcattatacctatattctatatgttcaagaagtgagaagaaggattaaccatgtaatgtagaaacatagaagatatttttaaaaacccaaatcaaacttttaaagatgaaaactacaatgtgagagagaaaaaatacatgacaagggatgaatagcagattagacattaccaaaaataattggtaaacttgttttcaaaaactgcaaaaagaaatagacaaatccacaattgtcatccaaaatttcaacacttcaatcctaaatattagtttcaaaaatagtagacagattacaaattaaaatgagatgcctctacatacctaccaaatgtctaaaacccaaaacactgacaacacccagtgctggtgagtgtgtggagcaactgtaagtctcattcggtgctggtgggaatgcaaaatggtacagccactttggaagacactttggcagtttctttaaaacttaacatactgttgcatacaaccagcaatcgtgcccttggtatttacccaaataagatgaaaa

SEQ ID NO: 46219 - DNA, 556 bp, Homo sapiens
gagagaggctgttcgcagagctgcggaagatgaatgccagaggacttggatctgagctaaaggacagtattccagttactgaactttcagcaggtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgaaaaa

SEQ ID NO: 46220 - DNA, 127 bp, Homo sapiens
accgaaagtatcatctcagggaaacttaattcctgcccgtcctgctcctgcacctcctttatatagttccctcacttgatttttttaaccttctttttgcaaatgtcttcagggaactgagctaata

SEQ ID NO: 46221 - DNA, 559 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgg

SEQ ID NO: 46222 - DNA, 358 bp, Homo sapiens
gggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccgcttctttgacattagaagacattagaagaaataatcagccttgcataaaacttatggatg

SEQ ID NO: 46223 - DNA, 261 bp, Homo sapiens
ggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctaaaaaaagaaaaaaaaaaaaaaaaaaaaaaaaaaaa

SEQ ID NO: 46224 - DNA, 357 bp, Homo sapiens
gaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaa

SEQ ID NO: 46225 - DNA, 536 bp, Homo sapiens
gattgtttgttggctttatcatcccttttgttattataattgtctgttacacaatgatcattttgaccttactaaaaaaatcaatgaaaaaaaatctgtcaagtcataaaaaggctataggaatgatcatggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacatttagaaagcattctttgtccagcgtgacttatgtacccagaaagaaggcctctttgccagaaaaaggagaagaaatatgtaaagtatagtttaaacccatttccagtccaaaccaatgaaaatagtttcccaaataagtattttgtcaaatcatttacaaaaaaaaaaaaaaaaaaaaaaaaaaaaaa

SEQ ID NO: 46226 - DNA, 640 bp, Homo sapiens
acagcctaacgctcttcgctgtcgtttgcggtctcgcgcagggcggccccggttctggtgtttggcgtcggaattaaacaaccaccatgtcgagcaaaaaggcaaagaccaagaccaccaagaagtgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctactgacaaaaaggggaatttcaattacatcgagttcacacgcatcctgaaacatggagccaaagacaaagatgactgaaagaactttagctaaaatcttccagttacaatgtc

SEQ ID NO: 46227 - DNA, 202 bp, Homo sapiens
tcagaaagatcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccaaaaaaaaaaaaaaaaaaaaaaaaaaaaa

SEQ ID NO: 46228 - DNA, 223 bp, Homo sapiens
ggtgaacattcctgatttttgtctgatgtgaaaaagccttggtattttacattttgaaaaattcaaagaagcttaaatataaaagtttgcattctactcaggaaaaagcatcttcttgtatatgtcttaaatgtatttttgtcctcatatacagaaagttcttaattgattttacagtctgtaatgcttgatgttttaaaataataacatttttatatttttt

SEQ ID NO: 46229 - DNA, 547 bp, Homo sapiens
acgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcctgcgggtctgtcagggttggaaagtccaagccgtaggaccagttcccttctagctgatgtcttggcagaacacgtgggctgttacttgctttgagttggaa

SEQ ID NO: 46230 - DNA, 347 bp, Homo sapiens
cgtgtccctgggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtggg

SEQ ID NO: 46231 - DNA, 312 bp, Homo sapiens
gagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggaaaaaaaaaaaaaaaa

SEQ ID NO: 46232 - DNA, 280 bp, Homo sapiens
tttacctcgttgcactgctgagagcaagatgggtcaccagcagctgtactggggccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacattt

SEQ ID NO: 46233 - DNA, 599 bp, Homo sapiens
aaagcaggaagcaagaagtgacaagagtccagatttggcacctactcctgccccacagagcacaccacgaaacactgtctctcagtcaatttctggggaccctgagatagacaaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtacaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcattttttttgtagagggtgatatataccatgtaaatgaataaaagacattttaaatttg

SEQ ID NO: 46234 - DNA, 371 bp, Homo sapiens
agaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacccgg

SEQ ID NO: 46235 - DNA, 498 bp, Homo sapiens
gaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaagacctgagagtttttgcagaaatggggcagagggacaccctttgggcgtggcttcctggtgatgggaagggtcttgtgttttaatgccaataaatgtgccagctggacaaaa

SEQ ID NO: 46236 - DNA, 536 bp, Homo sapiens
ggatttaagaagcatcctctgccaagaccaaaaggaaagaagaaaaagggcaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctt

SEQ ID NO: 46237 - DNA, 639 bp, Homo sapiens
atggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtggttattctatatgaatattggttcatggttggatgggaaaattgagctaaacattcattgtccccagtctgcaaaagaagcccaattctattgcttggcttgcttataggccattaaatcattacttttaccatatattgccggtacctctgcttcctttaaaaaaaatggtaaaggatggtttatggaggccccaagatcatatttttttaattttggccctaaatttgacaggcccattggaaggggccgg

SEQ ID NO: 46238 - DNA, 803 bp, Homo sapiens
  misc_feature 698, 700, 705, 707, 712, 713, 717, 719, 720, 721, 726, 738,745, 753, 762, 766, 767, 771, 775, 776, 779, 780, 791, 795,796, 797, 798, 799, 800: n = A,T,C or G
gacctcggccttattgggcgaagagacccagggcgagtatgaacaagcagggaatgctggactcctactaggctgtctatctagctaagatgattatgattcaaggaggaagtacaaaatggtattaaggctctcttcctccacccttaaaaatgtgggtgaagataagctacattttcccagaatctgctcaaaacaagacaaaagcgatgtactgagccaggtgaggaagaaaggcagtgcaccccacagacaagactgccctggttgtacggtgctacaacatgatctcagttgctgttaaataagtttcgcaagaaactgaagaatggaaagacaagagatgaggaacaagtttcagagaacagaaggaatttgtcttgggctgcacagcactaaggagagagcaggccccaaactgtgccattccctgcctcttgggagctatactcttctgtatccctgcttctgtcaacgtatctggctcaagggacatttacaaaggaaggaacactcgttgtatgaaaaacaaacatgatataaacctgttcgtagctttcaagactaccctacccagggtggctaccctaaagagaataccaaagttgataagaagaaagaatgataaaccatcagaattctcctatcacatttttcaaaaaatttcacccccatctggaagaaggaatttttcaatncnatttncnggaannaaangnnnaaaanggaaggggggcnaaaaacncctaaaanaaaaagggnaaanngggngggnnttnntttaaaaaaancccnnnnnnaat

SEQ ID NO: 46239 - DNA, 447 bp, Homo sapiens
gattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccac

SEQ ID NO: 46240 - DNA, 263 bp, Homo sapiens
ggttgaataatatatttgcaaagatgttaattctacagagagctaaataaagttaagatacctgtaaaacagtttctccagatgactttaaaatacgccttatttttgtaaatttatgttaaattttaggtgttaagttgtgaaatacctaatgatgtgggcctaaatttgcctcattcagactgagacagggctgttaaaattcatttctagctaataaactgtgctataactccaaaaaaaaaaaaaaaaaaaaaaaaaaa

SEQ ID NO: 46241 - DNA, 663 bp, Homo sapiens
atcttttcatggaccgatttccatttgtccaagcaccatttgttgtagagtatcttttccccattgaattgctttgatacctttgtctaaatcaattgggcataaatataagggtttatttctaaactcttagttctgttccattgatctgtgcctgtccatgattgtgtgttattgatgactctggctttaaagtatttgtaagtcattaaatcaggtaatgtaacacctccaactttgttatttttcaaaattcttttgacttttctagatactttgcattcccatgtcacttttatgatcagattgtcagttactacagaaaagccttctgaggttttaaatatatattgtgtttaatttacagatcaagttgagaattgccatcttgacaatatgaagtcttccagtctgtgaacatggagtttgtgtccatttatttagatattccttgatttctcttagcaatattttgttattttcagtatatacatcttacactcctttttgttaaaatgtcatattactttgcaattacgaatggatcgctgctgaattgtttcagacttttgggcagtaatagaatacatgatttgttatgactaatccgtgctgctaatcatcgtagttacatttaaaatgcggggctctgattcaatacag

SEQ ID NO: 46242 - DNA, 571 bp, Homo sapiens
gaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataa

SEQ ID NO: 46243 - DNA, 560 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttg

SEQ ID NO: 46244 - DNA, 509 bp, Homo sapiens
gattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgaaaca

SEQ ID NO: 46245 - DNA, 202 bp, Homo sapiens
agaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgg

SEQ ID NO: 46246 - DNA, 448 bp, Homo sapiens
atatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggttg

SEQ ID NO: 46247 - DNA, 649 bp, Homo sapiens
acaggattcctacttctgaaagtttttgggccccgcaggtggaagaccggagaagccaataaagtttaaggctacattttattccatccacaaatttggtgaaggaggaaatgtttacaattctgccatgccatgaataggagttttccaccgggtgtacactgctgttaacaaggtgtaaatacttgtccagtaaagagaccgtacggtactgctgatggacgtcccaacacaatgccagatgcaaaaacttctttggtgattgcttttgataacactgagtggctaaaggtcttctttcacatctttgcccacctcaaatcctgaaggcaaggtctctggaatttgaggctgtgccctcacatgcctccaaggcaccaacaaagcaaaatgaagagtctgcactgcttatcagttgacccaacactcagtccacattggaggggaaggggtggtgggctgaggatgtcttcttcctgtccaggatgcaatatggtcaaggatgaaaggaaagagatgctgggagcaagtctgcattgaagatgtattctgttgctttactacaaccctggttataaatgatgaaactataatggggtcgtaatagctactttccatatagctctgtctgtcatacataaaattaaaa

SEQ ID NO: 46248 - DNA, 116 bp, Homo sapiens
gttattaaatagtttacaactgactatttataccagtatgcatataatttttaaatatttgtaatgtgagatgttgaatgaataaaacttttaactcagaaaaaaaaaaaaaaaaa

SEQ ID NO: 46249 - DNA, 545 bp, Homo sapiens
atccgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagca

SEQ ID NO: 46250 - DNA, 234 bp, Homo sapiens
gtaccagattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctaaaaaaaaaaaaaaaaaaaaaaaaaaaaaa

SEQ ID NO: 46251 - DNA, 149 bp, Homo sapiens
  misc_feature 55: n = A,T,C or G
gggaaaaaatgtattgaaaacacttagtatgcagttgataagaggaatttggtanaattatggtgggtgattattttttatactgtatgtgccaccagctttactactgtggaaagacaactgttttaataaaagatttacattccatg

SEQ ID NO: 46252 - DNA, 540 bp, Homo sapiens
ggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatt

SEQ ID NO: 46253 - DNA, 305 bp, Homo sapiens
tgctgagggtgtgacaaatgggatctctcctacgttgctgtgggaatgtaaaacatacccactctggaaaatagtcccttcacaaaactaaaaatagaattgtcatataatccaccagttgcactcctgggcatttaccccagataaatgagaacttacattcacggagaagctttgcagaaatgttcatcgcagcatttttttttaaataataacccaacactggaaataacctagatgttcctcaaaaggtaagtggttaaagaaactgtgatccctccatacggtggaatactagtcagtag

SEQ ID NO: 46254 - DNA, 566 bp, Homo sapiens
gggggcgcgagcgacacgcgggagggagagcagtgctctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctacttttttttttagctatttactgtactttatgtataaaacaaagtcacttttctccaagttgtatttgctatttttcccctatgagaagatattttgatctcccaatacattgatttt

SEQ ID NO: 46255 - DNA, 110 bp, Homo sapiens
tagcaaggactaacccctataccttctgcataatgaattaactagaaataactttgcaaggagagccaaagctaagacccccgaaaccagacgagctacctaagaacagc

SEQ ID NO: 46256 - DNA, 332 bp, Homo sapiens
aaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgactgctaaaattaccaaataatttaaataaagtggatttgaacaca

SEQ ID NO: 46257 - DNA, 296 bp, Homo sapiens
  misc_feature 2, 6, 19, 21, 28, 29, 30, 31, 36, 45, 51: n = A,T,C or G
gnaggngggaggtaaaagnantcttagnnnnagacntcggccttnttgggngaagttcccctccaaaattacctgttggaacacatgaagacactaccccccgggggagtcacccagatccaggccttctgaaaccactcagattctctttcctcaaaggcacaacttcaagacaggaatcattatggcagacaggaagtcagtgtcaagattgaagggctcactcccaagtaatctcagtaaagccgcatttagacccaactcctcgaaaaaaaaaaaaaaaaaaaaaaaaaaaa

SEQ ID NO: 46258 - DNA, 300 bp, Homo sapiens
catcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgacaatt

SEQ ID NO: 46259 - DNA, 506 bp, Homo sapiens
caagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataa

SEQ ID NO: 46260 - DNA, 402 bp, Homo sapiens
gattgaacaggggaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttactcagagtgccatttttttttttgttcaaatgattttaattat

SEQ ID NO: 46261 - DNA, 679 bp, Homo sapiens
gggggagaaaaacagtaatttgagtttaactttaaactcttcctagtttttgctcaggagtcaagtcatgtccttgagggttatgacatccgttttcctcaaaagccatttttttcctgtcttccataagataagagatatgtgaagttaactttcagatgagtattattattactgcatgaataatcctttaaatacacatacttatgaaacaatttttttttgagacaaagatctcaaattaacaacccaacatcacacctcaaagaagtagagaaacaagaacaaaccaacaccaaggctgtcagaagacaagaaataaccaaaattagaactgaactgaaggaaattgagaagcaaaaaactatacaaaagatcaacgaatccaggagttattaagaagaataagtttcatagatcacgacctagactaataaagaataaaagaagatccaaataaacacaatcagaaatgttagaggacattaccacttgaccccatagaaacacaaaaactctcagagattactgtgagcacctttttggcacaaactagaaaacatacagcctggaaacatacagcctctcaagattgaaccaggaagaaattgaatcccctggacagaccaatagtgggatctgaaactgaatcagtaacaaaaaagcctaggaaccaaga

SEQ ID NO: 46262 - DNA, 578 bp, Homo sapiens
agaaatgcaagatttcaaaaaatatatatctcccatgcactgttcttcagaaagccttgggagaatgtaccctaccaaaagagggagtaataaactaggaaaagttgaatttgggaaatggaatcaacttagaaagaagcaaagaggcctgtaatgataaaggggttttctaggatgacagctccatagctggaatgggggacaaccagaccagaatggagctttagtagatatattctagagcaggaaattcgagaatatataaagtagctaaaatagaagaaaatgtagacaattgagtgagagttcaagggtgaaataacaatgttaaatactaaaaaatcaaagtaaaggaaaaaggacaattattaacttcaggaaagacaaagttatgcagaaaaggaaaagtaaccatgatataaacattgaatattgattgaaccacaattatgctctaactatattgggaagaagaaagaaagctgaaaatatgaaagagcgctaaatatttactcctacaggaaagagtcagtgatctccaaaacagaaaatgcaagatcagcacaataagagaagac

SEQ ID NO: 46263 - DNA, 481 bp, Homo sapiens
ggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataaa

SEQ ID NO: 46264 - DNA, 540 bp, Homo sapiens
ttaacagtcaaggtgttatttgcttggacatattgaaagataattggcgtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattgggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacata

SEQ ID NO: 46265 - DNA, 412 bp, Homo sapiens
aagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactg

SEQ ID NO: 46266 - DNA, 219 bp, Homo sapiens
atttgagtgatgttttaaatatcctacgtctgaaaataattcctcctaattgtgtggtaatttgcttttactgtttctgcagtatttcaggtctttgctcattcactcagtaatactgagcacttaccatgtaccagaattttactaggcacaaccatgaataaaaatacaattctcttgcaccattaaaaaaaaaaaaaaaaaaaaaaaaaaaaaaaa

SEQ ID NO: 46267 - DNA, 411 bp, Homo sapiens
agtggtggagatgactgaagcccgacacggcctgagcgtccagaaatggtgctcaccatgcttccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaata

SEQ ID NO: 46268 - DNA, 216 bp, Homo sapiens
tgaccacagatcatcagtactgttgtctcatgtaatgctaaaactgaaatggtccgtgtttgcattgttaaaaatgatgtgtgaaatagaatgagtgctatggtgttgaaaactgcagcgtccgttatgagtgccaaaaatctgtcttgaaggcagctacactttgaagtggtctttgaatacttttaataaatttattttgataaataatattga

SEQ ID NO: 46269 - DNA, 518 bp, Homo sapiens
gctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgtt

SEQ ID NO: 46270 - DNA, 621 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactc

SEQ ID NO: 46271 - DNA, 315 bp, Homo sapiens
gcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaaaa

SEQ ID NO: 46272 - DNA, 473 bp, Homo sapiens
cttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttgggtcatgtatctctgcaaagcatcaaattaaatgcacgcttttgtcatgtcaaaa

SEQ ID NO: 46273 - DNA, 187 bp, Homo sapiens
aactgtcctcatatgctcagatgtttgcttcttgtcagtggaagtgggaatatgggtttgctactttagcgaacttccttgttcatgaagatgttttttatcttctagaaatattttggtgagcagggtcaggggtttctgtgttttggagcctgaacctggaagccatagaactagaagtcgagga

SEQ ID NO: 46274 - DNA, 254 bp, Homo sapiens
agcagaggcattgatgaccacatgctatatcttaaaattttactgatagttgattttagcaagtcttatgaaacactaagaacaatgtctggtgcctagcaaattctcagtaaatttcagctagtattattacagttagtattactttactatgctccctgataaaatttttataataaaatggttaatgactttccattgaggtctgatctgacgtagttttagcataaagtaattacaattcatttttagag

SEQ ID NO: 46275 - DNA, 321 bp, Homo sapiens
ataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaaaaaaaaaaaaaaaaaaa

SEQ ID NO: 46276 - DNA, 290 bp, Homo sapiens
gtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggattta

SEQ ID NO: 46277 - DNA, 222 bp, Homo sapiens
agaccccaggctggacgtgctgactgtcctctcccctccagcctttggccttggcttttctagcctatttacctgcaggctgagccactctcttccctttccccagcatcactccccaaggaagagccaatgttttccacccgtaatcctttctgccgacccctagttccctctgctcagccaagcttgttatcagctttcagggccatggttcacattaga

SEQ ID NO: 46278 - DNA, 540 bp, Homo sapiens
ggagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatcta

SEQ ID NO: 46279 - DNA, 610 bp, Homo sapiens
atgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaaagttgtggaagtttcttaatctgacagtggtttcagtgtgtaccttatcttcattataacaacacaatatcaatccggcaatctttagactacaataatacttttatccatgtgctcaagaaa

SEQ ID NO: 46280 - DNA, 319 bp, Homo sapiens
atacaaaaatcagctcaaaatggatttaaaaacttaaatataaggtcctaatccgtaaaactactagaagagaacatagaaaaaaagcttcttggctttagtctgggcaataatatttttggatatgactctgaaagccaggcaacaaaagcaaaaatagacaagtggaattcaccaaactcaaaagcttttgtacagcaaaggaaacaatcgacagagtgcataggcaacttacagaatgggaggaaatatttgcaaaccatgtatctgataagaggttaatatcccaactgtgtaagtaataagtacaactcattag

SEQ ID NO: 46281 - DNA, 336 bp, Homo sapiens
tcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacactttgcttcatt

SEQ ID NO: 46282 - DNA, 109 bp, Homo sapiens
agcctttctaaccacaaagaagttgcgaaggctgtatctgtcccacaatcaactaagtgaaataccacttaatcttcctaaatcattagcagaactcagaattcatgaa

SEQ ID NO: 46283 - DNA, 54 bp, Homo sapiens
aagcaaacaaaaatgctaggcctagaaaacaaaaacgaaaaaaaaacaaggggg

SEQ ID NO: 46284 - DNA, 629 bp, Homo sapiens
tccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttgggtattgtaaaaaaaggagagaaggatattcctggctgctgatctacagtgctcgccgcctggccccaaaagagctagcagaatccgcaaactttcaatctctctaaagaagatgatgtccgccagtatgtgtaagaaagcccttaaataaagaagggaaagaaacctaggaccaaagcacccaagaatcaagcggcttggtacctccacgtgtccctggaacacaaaacgggcggcggtaattggctctggaaagaaagc

SEQ ID NO: 46285 - DNA, 57 bp, Homo sapiens
gctaaggactgcaaaaccccactctgcatcaactgaacgcttatcagccactttaat

SEQ ID NO: 46286 - DNA, 261 bp, Homo sapiens
atgctcatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagaaaaaaaaaaaaaaaaaaaaaaaaaaaa

SEQ ID NO: 46287 - DNA, 630 bp, Homo sapiens
cgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaacgccattgacatggaaatcattgtgaatgcaaagactttggatggaggcctgaatgtcattcaattagaaactgcagtaggggctgccatcaaaagttttgagaattctctaggtattaatgtgccaaggagcccgttttctgcctgtcaaaacccatcagatctcttgctggtgatgtcaaacctctatagccttaatgcaggatctctgcaatgagtgaaaagcgggaatttcctacagtgcccttgggtaaattaggcagtcttttacgaaggtcaagattatctaagaagatttgaaatataccagatatgcttgaatggacacctcacagttcaggagatggacattgggaaaaaggtcattaaagggacggtttcatcatgcaaacatggggcagaatgatttccccct

SEQ ID NO: 46288 - DNA, 573 bp, Homo sapiens
aatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctctttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctccatcagaaagatcattggcatgccaca

SEQ ID NO: 46289 - DNA, 352 bp, Homo sapiens
attaaaaagaatgagatcatgtcttttgcaggaacatggatggagctggaggctattatccttagcaaattagcacaagaacaaataccgcatgttctcacttataagtgggaactaaatgatgagaacttacgaacgcaaacaaggaaacaacagacacagaggtctgcttgagggtggagggtgggaggagggaaaggagcagaaaagataacaattgggtactgggcttaatacctgggtggtgaaataatctgtgcaacaaaccctaatgacacaagttcacctatgtaacaaaccttcacatttaccccccaaacctaaaataaaagtttgctttttttaaagaaaa

SEQ ID NO: 46290 - DNA, 249 bp, Homo sapiens
caagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtaaaaaaaaaaaaaaaaaaaaaaaaaaaa

SEQ ID NO: 46291 - DNA, 320 bp, Homo sapiens
tttgaaaacagactgaatggtcgtcggaagaagaacaggaaaagagatgaagtggcggttgagctatcactatggcaaaaacataaatattatctcatttcagtgtgtggagttgtggttgtagtgtttgcctggtacatcacccatgatgtcaattaaaaaaagttttgatcttttaatgtaactcagattggctttagataagttgttaaatttgaaatattagaaaatgtatattacagaacatgatatatatttacattcatctctgtattctctcagctgttgttagaaggacagaatgttaaactttatcttaa

SEQ ID NO: 46292 - DNA, 523 bp, Homo sapiens
agaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttccgccttgttttttcagtttgctgtttctgtagccatattgtattctgtgtcaaataaagtccagttggattctggaaaa

SEQ ID NO: 46293 - DNA, 578 bp, Homo sapiens
gaggcattgaggcagccagcgcaggggcttctgctgagggggcaggcggagcttgaggaaaccgcagatgagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgggaagattaattgggagtgg

SEQ ID NO: 46294 - DNA, 680 bp, Homo sapiens
  misc_feature 645, 648: n = A,T,C or G
gacaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaaacagttattctatcaacttttaaagggtttaaacctgcccagaaattaccttgggaaccggaagtttccccccggcctcctcctcnaantaagcctgttaatttgtcatgccccagcattg

SEQ ID NO: 46295 - DNA, 146 bp, Homo sapiens
tccccgctactcaggaggctgaggcaggagaatcgcttgaacacaggaatcagaggttgtagtgagccgagattgcgccactgcttccagcctggcgacagagcgagactccgtatttaaaaaaaaaaaaaaaaaaaaaaaaaaaa

SEQ ID NO: 46296 - DNA, 578 bp, Homo sapiens
gatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatat

SEQ ID NO: 46297 - DNA, 127 bp, Homo sapiens
gattgctgtgaactagttattcaacttataatttatgttactccttgatctttgtcttttgtcatgacaaagcatttatttaataaagttatgcattcaaaaaaaaaaaaaaaaaaaaaaaaaaaaa

SEQ ID NO: 46298 - DNA, 360 bp, Homo sapiens
gtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacgtatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 46299 - DNA, 189 bp, Homo sapiens
atccgaaaatcaatgagttggctactaccttgatgtaaaaatttgtaaggaaaattttcaccatttcgagtgtcaagtgtatttttaactgtctggtttgtacttttatgacttttgtactaccaaagcggagttaaaaataaaaatgttaaacgcagaaaaaaaaaaaaaaaaaaaaaaaaaaaaaaa

SEQ ID NO: 46300 - DNA, 241 bp, Homo sapiens
cttgccttttgtgtttgagttatttttaacattttcctgtaaatattttgtaatattttacttgtaatgaaatggatcacaaggtcctttcccaatacaaggcaggatatgtgggaagaatacgtacaattatttgattaaaattatttcccactgacctaacctttcagtgatttgtgggaaaaataaataaatgttctacaccaagatactctgtgttactgacaatatgtaaacataa

SEQ ID NO: 46301 - DNA, 510 bp, Homo sapiens
tgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgg

SEQ ID NO: 46302 - DNA, 607 bp, Homo sapiens
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatcatac

SEQ ID NO: 46303 - DNA, 188 bp, Homo sapiens
actcctacaaagattagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaaaaaaaaaaaaaaaaaaaaaaaaa

SEQ ID NO: 46304 - DNA, 171 bp, Homo sapiens
taggttcagcgggacctatcataaagactataatttgcacgtgttttctaaccattttaattatggcatatttagactgagagctaaataaatggatcaagttcacttaggtagccttagctgacacacgataaaaagagaaagaagaaaagcgggaatgagaaaaagtgc

SEQ ID NO: 46305 - DNA, 690 bp, Homo sapiens
tggcggcctgctggcaaccatcctgagaaatgtatgggttccattatttttcagaagagccactcattcctatttataagggaatcaacatggctttgttggggggttctcattctctctgtctcattgagtttaatggagaaagagggaacacttgcttattttctataactgagcatcttcaattatcgtaaggaattatggattgcaagcacctgcattttctcaatctatgatttcctccatgcagcaatgcaaattagtagaacaggtgaggcaccaggaactacagcaccacttaatttattaactacagaaatcaataagaagcacaaggttggtaggacttcataaattttcaagcaaatcggcttggatttccatattaatgcaaaacccagactccctccttcttgggttctttgccagtagcctgcatagccactgcccttgtggtactgcatcattataatgcaggcagtggcttggtggcataagctatcttatttggacctaccagtcctggttggctgatgctggttggtttcttcaagggataaatgaggtttgctcttggtcagaacatgccctgaaccaacgttgctttcctcatggggataggctctctgaccggtgatccggatttagaacaaggccgttttcccaaatggcaagacactattctaaaaa

SEQ ID NO: 46306 - DNA, 87 bp, Homo sapiens
ccctaaattacacttccatctctgtcagctagggtttgattaaagaagcaaaattattagtgtttaagagatgtatagccgagacag

SEQ ID NO: 46307 - DNA, 150 bp, Homo sapiens
cctcttgctggtcactaccgtcgctttctatttctctttctttgtgtgaatttatttaaaagaaaaaaaaactttttgtaacgactatttgcagtttaaaaatcaataaaccccgttttttcaaaaaaaaaaaaaaaaaaaaaaaaaaaa

SEQ ID NO: 46308 - DNA, 191 bp, Homo sapiens
atagaaatggaagcatgcactatgtggccttttgtttctggcacctttgagtttacataatgttttcaaagtctcttgtttttaaacttagcattccattatggggattattatatatgctgaacatcgagatttacttcattgtttttaatggctggatatcattttattaaatgagcagagtttaattt

SEQ ID NO: 46309 - DNA, 166 bp, Homo sapiens
acctaattggcatgcgccatcctagtatgatcaaccattaaccttccctcaacacttatcatcttcacaattctaattctactgactatcctagaaatcgctgtcgccttaatccaagcctacgttttcacacttctagtaagcctctacctgcacgacaacacat

SEQ ID NO: 46310 - DNA, 619 bp, Homo sapiens
aggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacccgggcatggtggcaggtgcttataatccagctactctgggggcaaggcaggagaattgcttgagcctgggagatggaggttgcagtgagctg

SEQ ID NO: 46311 - DNA, 344 bp, Homo sapiens
atgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccag

SEQ ID NO: 46312 - DNA, 306 bp, Homo sapiens
actccagaaatgaaatcacttgagccacattctccatatataatcaaagttgatataactgtagcctcattctccatatataattaaggccattgaagtttaaaatatttgaatataggagcatgataacggttccttatttcctacaacatgacctacatataaatgtaacatgtgccaacattgagtctggaggggtggcagatgagctgaaaaacatgatgtgacttagtacacatggacaaagtagtttctaattaaacagccacttaccatggcaaaaaaaaaaaaaaaaaaaaaaaaaaa

SEQ ID NO: 46313 - DNA, 548 bp, Homo sapiens
aactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccaaagctttcccccgccttttagttttggttcctccactggaatgtaggctccccacgggcgatggctgtcttttccttgactttgtatcttcactgccaagcaaaagtctgccaagttgggaatgtttaataaata

SEQ ID NO: 46314 - DNA, 616 bp, Homo sapiens
cttttgggtgaagggtgatttctactagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaaccctgttaggaaggttggatttggcgtgacttgcttgagcaagagtcctggggagagattttgaggtttaatttaacggtatatccaagagctaacagtgactcaactcgtctagttctgcaagtcaaatgtacaccttaagagtctcctctgttaaaggggttgggtctgaacctggtgtatatgtcaaaacggccaataag

SEQ ID NO: 46315 - DNA, 224 bp, Homo sapiens
aatcaaggaaaatatttagatgcaacttactacagtgatgatgtgaaagaaatggtgattctggtaccatggcgtttattttctttcttataactgcagagaaaatatcctgactaaaaaaatttcatttttttggattcctttcttttacaaattgtgctgaggcaactatggcatagaaataaacatttggcaggggaaaaaaaaaaaaaaaaaaaaaaaaa

SEQ ID NO: 46316 - DNA, 487 bp, Homo sapiens
ctgaaattgtattcattatcttctagaaaccaagagtggacttggtatccgtctgattatattttctttgttggtaaagagcctcttttttccctttttattttcatcttctctttctctagtgtttataatcttatttttatgaatgtagtctaattatttagaacactgtctccgagtatgtgtttatttgggtttgtgttttgaacattgcctccaggtgcgagtttatgtgtgtttatgtttcctatttgaggttggacacttagaaaattttctcaattcgaaaactattttccttcagcactcagaaatttttatcaaagattatttccacgattatttcctgtccttggtttttcgtgttcttaacctagaattcaattgtttaatgttagaccttacacatcttcaatgtatcatatatatttcactcatattatttattgtcatatcttttggactattgtgtgaaagcaataaatgt

SEQ ID NO: 46317 - DNA, 343 bp, Homo sapiens
aaggtcggtggccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattta

SEQ ID NO: 46318 - DNA, 269 bp, Homo sapiens
ggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcgaaaaaaaaaaaaaaaaaaaaaa

SEQ ID NO: 46319 - DNA, 669 bp, Homo sapiens
gagggtcatctcttctattgtacctgcagcacgcttcctgggctgttacagtcaatggacttatcaacactgaaatgttatcctcctggccagccagaaaaattttctgcacttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcatcgggtccaaatcctaattgcagtttagtgaaattactagatttttttctaatcttcagtatgtagtgagcattcacaggttttctcctaagaatctcaagtggaattggaatcataaaaatgaatgagatttgaaaactttcacaaagattataaatgtagttagtttgatactccttaagaataaaaaaatgaaacagtaacaacttttatgtaaaaaaattttacataagagttagcatctttagctttataatctaagggaccaaatttaaaaaatgatgggttatgctctgtgaaatgaaaagttcaatcattggcctaaaaaaagatgatcaaggttaggttgatcccctggacctggg

SEQ ID NO: 46320 - DNA, 205 bp, Homo sapiens
  misc_feature 205: n = A,T,C or G
agaaacaccagcatcaaaagaagggaagcagaacggagagcaagactgcttctcaaggaagccttggacgctgcaggtgataaacttgtagtagttgacttctcagccacgtggtgtgggccttgcaaaatgatcaagcctccctttcattccctctctgaaaaggattccaacatgatattcctcgaagtagatgtggatgacn

SEQ ID NO: 46321 - DNA, 352 bp, Homo sapiens
aatgaaataaaataatccatctgtctatactagcataaagaaagaaacaaagaagagatagtgttccttcatataatgtcaacaaatgtggaagaataatagaagcaggaaaatcacaattggatagcaattgtaacaataataaattcagccaagaaatatcaggggatgctaaaagtgggtgcagatttaaagaggaacaaaatatttacacgtctctaagtatttcctcacaaaatacttactgataatggacaaaagaacaaccactgagtaaaacttcctggcaggtaccctcttgaatcaaatgatcaaagttaagaactccaaaaaaaaaaaaaaaaaaaaaaaa

SEQ ID NO: 46322 - DNA, 123 bp, Homo sapiens
ataatgctttgcggaccactttggttttcttttttgcgtgtggcagttttaagttattagtttttaaaatcagtactttttaatggaaacaacttgaccaaaaatttgtcacagaaacttgtg

SEQ ID NO: 46323 - DNA, 458 bp, Homo sapiens
ttcacctacacagttctggaggatggatgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgacacttctcttttttttgctgttccaccaaatacaattcaaatgctttttgttttatttttttaccaattccaatttcaaaatgtctcaatggtgcataataaataaacttcaacactctttacga

SEQ ID NO: 46324 - DNA, 239 bp, Homo sapiens
ccagatgaggagccctgctctcaagaaattggaagtgtgtactcctgagaggcaggagcagagccactatctccagtgaaccagagatggcaagacctgaattgcgggaaactatcagatctcttgttatggccctgccgaccttgctgtgcgtatatatataacactttgtccttcatatgtgacagatccagtgttggaattctttggtgtaaataaacgtttggttttatttaaaa

SEQ ID NO: 46325 - DNA, 372 bp, Homo sapiens
gccttttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccctcaggaggaagcagcactaaaagcactctgagtcaagatgagtgggaaaccatctcaataaacacattttggataaaaaaaaaaaaaaaaaaaaaaaaaa

SEQ ID NO: 46326 - DNA, 243 bp, Homo sapiens
ggagaatgtggacctaaatacccagaagcacccccctttgtaagatttggcacaaaaattaatatgaatggagtaaatagttctaatggagcggaggacccaagagccatatcagtgctagcaaaatggcagaattcatatagcatcaaagttgtcctgcaagagcttcggcgcctaatgatgctaaagaaaatatgaaactccctcagccgccgaaggacagtgttacagcaattaatcccc

SEQ ID NO: 46327 - DNA, 488 bp, Homo sapiens
atgtaaaattcagtggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattgaatccctttccttcactgaaatggagggagtttataagcttacgttag

SEQ ID NO: 46328 - DNA, 576 bp, Homo sapiens
gtatttgggtgaatgttgttgctctgtgcctgttgaatgtccatgctacaagaagttatgagccttgttctaagtacagatgaaccttgtatttgtgtaatctcccaagggagagctatggtttacattcaattttttggtctttctgctatgaaacgtgtttattttgcctctgtcaatgtgtttgcaaccttaagtaaggaaagggaaaaaaaaatagccctctgaactctgatcttttgccgcttctgtagattttgattgtgaagttgggagtgaggacattcaaaagcccatggtgaatgcatatgcctttagaataatgtgcctgttttaaaatgtttgagcttttaaaatactttgttaaaacatgaatccatttttgtaattgtataaatactcataactaaatttggatgctaccggatggggtaactgaattttggtatccaaaaaacatcctggggtacaactttcctacctgaaaactattcaattacaaatatgtttcttaagccaactaacttaaaggaagtgcaacgtcctcccccacaaatgtagtttttgcttctctca

SEQ ID NO: 46329 - DNA, 277 bp, Homo sapiens
ggacagatcatcggtcaggcaaaagaaaggctcacgagcttgagccccctcttagcatatattggaactggagctactggagcaacactgtatcatctgcgcgtgtggcattgttcaatccactgtttggtgggacagaaataacccagagccctggaacaaactgggtcccaatgatcaatacaagttctactcagtgaatgtggattacagcaagctgaagaaggaaccgtccagatttctaaatgaaatgtttcactataacgctgctttagaa

SEQ ID NO: 46330 - DNA, 276 bp, Homo sapiens
tttataatcatcttaaagtatgatttgatattttcttattgaaattaccttatcatgtgttaggggccgtctttatgttgaaaactaatttcttaaaataaagccttcagtgaatgttcattaccaacttgatgaatgctactcataagagctggcctggggctatagcatatgctgtcattattttaaatgctccatgtgtcaaaaaactctgtggaaacctggacggtccaatgaaatgcataacccacgagctgattgaggcggctattatga

SEQ ID NO: 46331 - DNA, 209 bp, Homo sapiens
  misc_feature 61, 62, 65, 66, 68, 73, 82, 85: n = A,T,C or G
aaattctttaatatatattcttcagaagacagttttgaccacagtacatatgactgtagtnntgnntngattnacatacatncanaccataactctggtctctcctattttatgatttcaactttaaaaacaaaaataaacgaggataatctttactggtgaaaaggatggaaaaataaatcaacaaatgcaaccagtttgtgagaaaa

SEQ ID NO: 46332 - DNA, 367 bp, Homo sapiens
cgcagaaaacttacattctagttctcttcacacagtagctgttgtaaataatttatgaatgacagaacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgctgttaaaaaaaaaaaa

SEQ ID NO: 46333 - DNA, 432 bp, Homo sapiens
aaatgaagtgattctaagatttgtattgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggataattatggtgggtgattattttttatactgtatgtgccaaagctttctactgtggaaagacaactgtttaataaaagattacattcc

SEQ ID NO: 46334 - DNA, 337 bp, Homo sapiens
cggcggtgacgacctacgctcacgagaacatgcctctcgcaaaggatctccttcatccctctccagaagaggtgaagaggaaacacaagaagaaacgcctggtgcagagccccaattcctacttcatggatgtgaaatgcccaggatgctataaaatcaccacggtctttagccatgcacaaacggtagttttgtgtgttggctgccccactgtcctctgccagcctacaggaggaaaagcaaggcttacagaaggatgttccttcaggaggaagcagcactaaaagcactctgagtcaagatgagtgggaaaccatctcaataaacacattttgga

SEQ ID NO: 46335 - DNA, 660 bp, Homo sapiens
gagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgccaaaaaaatcgatctacattatcagaacctgcggtgaaattaaacttatgttaaataaaaccagttgcaggtgcacaaactatgagggtcttgtatccacgtaacacaggtagttacaaaaacatgttattgtactgtgtaaagatgcatagtcatctcattggtggcttgtaccttgacctttttagccttggctttggtggactagaccctcagcaatactgtgtggacctttgtaaatgatattaaaaggaatttgcacataatcattggaaaactggatgaaaacaat

SEQ ID NO: 46336 - DNA, 434 bp, Homo sapiens
gagcacggttcgtttttcctttagtcaggaaggacgttggtgttgaggttagcatacgtatcaaggacagtaactaccatggctcccgaagttttgccaaaacctcggatgcgtggccttctggccaggcgtctgtgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacagttaaca

SEQ ID NO: 46337 - DNA, 540 bp, Homo sapiens
gggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgagggagccagagacttcttaaatcatccttagaaccgtgac

SEQ ID NO: 46338 - DNA, 610 bp, Homo sapiens
ttgttgctgagggcaacagcaggttcacttacactgttcttgtagatggctgctcaaaaaaagacaaatgaatggggaaagacaatcattgaatacaaaacaaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatggggtg

SEQ ID NO: 46339 - DNA, 215 bp, Homo sapiens
agtttaaggaaacaagcatatagatgcattagtgaccctgctaaaaccacgtagaatataacgatctcttaaaaataccacagtttgtattttttctttaaggagtaaagatttgcctttaaataacttggtattttcctggctttcgtttaatacaatagaaaataaagtattacaccgacctaaaaaaaaaaaaaaaaaaaaaaaaaaaaaaa

SEQ ID NO: 46340 - DNA, 557 bp, Homo sapiens
atacttaagcacatatatacatggtttgtttatggttcatttccccccagtattttttctccttgcttttcagttttggaggtttctgttacatacatatatcctcaagctcagagactctttctggtgtgtacatgtgcttgtatgtgcatgtatatatttatgcttatttatatgtgaaatgcatgacagaaattatacaagggatggatggaaggaattagcattattttgctattataaggtattcatactactcatgaaatgatctagtggcacttgaaggtggacctgaattagttgtaaatgtatattgcaaactctagggccagcacaaagaaaaagtaatgaaagcagtataaccaatgtggtgagaaaggagtgaagataagatcacgtaaaatgctcaactaaatccacacaaggcagaaaaagggtgaatgacaaaaataagaacaaataaatgaaaacaataaatatggtagactttgatctaattgtcagtaatcacttcgaaggtcagtggtctaaatgtacaattaaaaggcagattgcag

SEQ ID NO: 46341 - DNA, 149 bp, Homo sapiens
ttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaa

SEQ ID NO: 46342 - DNA, 299 bp, Homo sapiens
caagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatactttttgttttatttttttaccaattccaattttaaaaaaaaaaaaaaaaaaaaaaaaaaaa

SEQ ID NO: 46343 - DNA, 243 bp, Homo sapiens
gggactagggtaatctgacttcgcacttcctaagttcccttctatatcctcaaggtagaaatgtctatgttttctactccaattcataaatctattcataagtctttggtacaagtttacatgatgaaaagaaatgtgatttgtcttcccttctttgcacttttgaaataaagtatttatctcctgtctacagtttaataaatagcatctagtacacaaaaaaaaaaaaaaaaaaaaaaaaaa

SEQ ID NO: 46344 - DNA, 580 bp, Homo sapiens
tgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacaagagggaagtttaaaacccaaacttccaaaggtttaaactacctcaaaacactttcccatgagtgtgatca

SEQ ID NO: 46345 - DNA, 573 bp, Homo sapiens
gatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactgatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagacgcaaacaaaatacttttacccacttaaaaagagaatataacattttatgtcactataatcctttgttttttaagttagtgtaaattttgtggtggattaaccttttgt

SEQ ID NO: 46346 - DNA, 558 bp, Homo sapiens
caagaataagtttgtggagtttgacatgaagccagtctgtgagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaagggcacagaaaagaaaaataaccacccaaaaaaaa

SEQ ID NO: 46347 - DNA, 350 bp, Homo sapiens
actgacaaaaataccaaaataaaagtgtatttttaagttcccatttgaaattgctggcgctgctggccggacgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttaaaaaaaaaaaaaaaaaaaaaaaaaa

SEQ ID NO: 46348 - DNA, 563 bp, Homo sapiens
cgagggcctgggttcgaatgaccgaaggggcccggagcattctggttgccaatgcaaagagagaaagggggggactcaccacgcccataaggtacaggcaaattaggcacttgagaggctcagatattcctagttatgaaacctcagagcaatatctcctgagggggcattatgtaaaaatgcctgcaaacatctgtacagttaacatgatggagccatgaatctatttcttacaatatctcaaaacggggggtgactcactcaagaggcatttcaggaaaagcaatttatttcaatggaaggcctccttacattaaataagaacattgacaaacagcagggtacttaacaatttttggagctttaaatatgaatccacatgctatgtgaggcaggaaatgaatttggggtttattaaatcattacataaaagagggctggagtcaattatctgaatcctagtactaataggaagcaggaaaattctaatatctgaatacctacttacaacccagccaaaataaaggggccgggatggcatttttaaatccaatgattcaaaa

SEQ ID NO: 46349 - DNA, 329 bp, Homo sapiens
gataattaccggacagttgggaaatagcacaaatctgggataagggaaggagagaaagttgagggagtacttaacaatgactagagatgaccctcttgggaatatggaactagttaaatgttattagcttttcaagttggtctaggactatccctggctatactgtccaggacatgtagtaattaatcaattcagcacctacttattgagtgcttgttaagcattgagcactatatgtgggtcataagatatattccctgcttttttggtgcttatgcagtgattctcaaactattatgattagaatattcgaaaaaaaaaaaaaaaaa

SEQ ID NO: 46350 - DNA, 148 bp, Homo sapiens
atatgaagaattaagacagtgtgtacgaaatgctccccagtttagatttgactggtttatcaagtctaggactgccatggaattccagagacgctgtaacactctgatttcattgattgaaaaaaaaaaaaaaaaaaaaaaaaaaaaa

SEQ ID NO: 46351 - DNA, 621 bp, Homo sapiens
gtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggggtgatacttt

SEQ ID NO: 46352 - DNA, 509 bp, Homo sapiens
ggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgtt

SEQ ID NO: 46353 - DNA, 471 bp, Homo sapiens
cttccttcaggatatcaagaaaccagactgtgatgactgggagagcgggctgaatgcaatggagtgtgcattacatttgaaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 46354 - DNA, 543 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgccatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcctcttt

SEQ ID NO: 46355 - DNA, 250 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcaaaaaaaaaaaaaaaaaaaaaaaaaaaaaa

SEQ ID NO: 46356 - DNA, 594 bp, Homo sapiens
taaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacctcatatgtaacaggtgcccttatgttgtgctgtatcctgtgctttttctgtgggaccattccattcaggagcaaagagcaccatgattccaatcttgtgtgtgtctactaacccttccctgaggtttgtgtatgttggatattgtggtgttttagatcactgagtgtacagaagagagaaattcaaacaaaatattgctgttcttcagttttgtttgtgggaatttgaaattactcaaatttaaaataaattactggactgtggaaac

SEQ ID NO: 46357 - DNA, 158 bp, Homo sapiens
tacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgc

SEQ ID NO: 46358 - DNA, 370 bp, Homo sapiens
accggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgtgcgatacagggtgacagccccgtacacaaaaatgcacatattgtgagctcgatgagtagggcgggacacgtggtaccctgtctgaatatggggggaccatcctccaaggctaaatactcctgactgaccgatagtgaaccagtaccgtgagggaaag

SEQ ID NO: 46359 - DNA, 347 bp, Homo sapiens
ctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgactaaaaaaaaaaaaaaaaa

SEQ ID NO: 46360 - DNA, 515 bp, Homo sapiens
gaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattgccagaccaactacctggtggtggctgccgtgatgatttccattgtggggtttctgagtcccttcaacatgatcctgggaggaatcgtggtggtgctggtgttcacagggtttgtgtgggcagcccacaataaaggcgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaactcaagaacaaactggagaataaaatggaaggaataggtttgaagaggacaccgatggggc

SEQ ID NO: 46361 - DNA, 760 bp, Homo sapiens
aggattattaataaagcgtgaatattttgttttttattatagactgaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatatatatgttatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgcccccctaaatcaagaagacgttctaaaggcaagtaaagaaaagtgtgaaaatgcctagtattaaaagggttaattttttttttcttttccctaaataacctaaaggtggagggggtaaaaattggagcccctggaataattaatttaaggttaaaagggtttttttaattaaaataaaatttttgggcctgggaccttttaattttaagccttggaattaagggtttatttaatcctgggcaaaaaaccctttttaaaggtttgaacaaacccttgacct

SEQ ID NO: 46362 - DNA, 497 bp, Homo sapiens
gaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaa

SEQ ID NO: 46363 - DNA, 404 bp, Homo sapiens
aagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaacca

SEQ ID NO: 46364 - DNA, 255 bp, Homo sapiens
atccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcaggga

SEQ ID NO: 46365 - DNA, 490 bp, Homo sapiens
aggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 46366 - DNA, 529 bp, Homo sapiens
gttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcctgtactagctatgtttctataagatatggtgccctgtgtatcccagagatgctagaaaactgttctttgctctatttgtgggtc

SEQ ID NO: 46367 - DNA, 566 bp, Homo sapiens
gtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttaagtcactgtcaagtcatttgacacctccctcattaggaagacaagggactatccttgaggcaaaacaagcggaaaaagaacatgtttatc

SEQ ID NO: 46368 - DNA, 189 bp, Homo sapiens
attgtctacagagaccaactgggatattgcccacatgatcaagtggctttgaatgaaatacagatgcattatccagaactgaagttgccctacttttaactttgaacttggctagttcaaagatagactcttcttttgtaaagtaaataaattcttcaaataaaaaaaaaaaaaaaaaaaaaaaaaaaa

SEQ ID NO: 46369 - DNA, 531 bp, Homo sapiens
attaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactccaaaactctggtattataacttttgaaagttaatatttctacatgaaatgtttagctcttacactctatccttcctagaaaatggtaattgagat

SEQ ID NO: 46370 - DNA, 191 bp, Homo sapiens
gggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaaaaaaaaaaaaaaaaaaaaaaaaaaaaa

SEQ ID NO: 46371 - DNA, 399 bp, Homo sapiens
gaaacacaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataattcctcaaagtaaaattgagaaatctttaagtttttttcaagtaacataatctatctttgtataattcatatttgggaatatggcttttaataatgttcttccccaaataatcatgcttttttcctatggttacagcattaaactctattttaagctgtttttggg

SEQ ID NO: 46372 - DNA, 500 bp, Homo sapiens
aaaccatgaagagccggatcctttttgccatcctggccgcttagcggtagtaacttcgcgttatgaatcacatgaaagcatggaatcttatgaacttaatcccttcattaacaggagaaatgcaaataccttcatatcccctcagcagagatggagagctaaagccaagagaggatccgagaacgctctaagcctgccacgagctcaatagggaagcctgtgatgactacagactttgcgaacgctacgccatggtttatggatacaatgctgcctataatcgctacttcaggaagcgcgagggaccaaatgagactgagggaagaaaaaaatctcttttttctggaggctggcacctgattttggatccccctggagcagcattactgaaatacataggcttatatcaatgctctttccaggatatctctggccggctgccccctttttcccgccccagattgataagaaaggaaggccccgcgggagggccaaaggag

SEQ ID NO: 46373 - DNA, 116 bp, Homo sapiens
aacgaagtgactccgtggacattgctgctctcgggggtgttttctaattttctgtgatagggaaacaaattcttttgaataaaaataaataacaaaacaataaaagtttatcgagt

SEQ ID NO: 46374 - DNA, 448 bp, Homo sapiens
atcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacaa

SEQ ID NO: 46375 - DNA, 172 bp, Homo sapiens
atttaaacttttttctttaccacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtca

SEQ ID NO: 46376 - DNA, 619 bp, Homo sapiens
gaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggataggaataagctctagttcttaacaaccgacactcctacgagatttagaaaaaagtttacaacataatctagtttacaagaaaaatcttgtgctagaatactttttaaaaggtattttgaatactattaaaactgcttttttttttccaagcaagtttccaaccaacttgggtctgcttcaaaaaaatcttgggaaaactaaatt

SEQ ID NO: 46377 - DNA, 366 bp, Homo sapiens
ttgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtgtcagttgcaggtgccaatgactaactttttgaattctatgttggcattaacaataaagcattttgcaaacactg

SEQ ID NO: 46378 - DNA, 520 bp, Homo sapiens
tataagaactggtctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactg

SEQ ID NO: 46379 - DNA, 515 bp, Homo sapiens
gaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtca

SEQ ID NO: 46380 - DNA, 205 bp, Homo sapiens
tttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctc

SEQ ID NO: 46381 - DNA, 588 bp, Homo sapiens
tagcattgaatcctagcccatctgcagagcaatgactgtgctcaccagtaaaagataacctttctttctgaaatagtcaaatacgaaattagaaaagccctccctattttaactacctcaactggtcggaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggggctgcttttgtcacactagcatagagaa

SEQ ID NO: 46382 - DNA, 370 bp, Homo sapiens
acggtggtgtttccttgaggaagagtgagggttcaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacata

SEQ ID NO: 46383 - DNA, 316 bp, Homo sapiens
gagggcattgaggcagccagcgcaggcgcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaaaaaaaaaaaaaaaaaaaaaa

SEQ ID NO: 46384 - DNA, 415 bp, Homo sapiens
attgaggtataattgacaaagttatatatatttaaagtatgaataccacatttggggaatgaacctgtccatcacctcgcgtagttacccttgggggcaagttgacagtgatgaggacagttaagatctgctctctgtaaatttcaactatataatatgatactattaactatagtcaccgtgctgtgtggtagattcttagaactttgtcttacattttgtcattattttatagtttagtattttaaaaacttactctgataataaaatgtaacacgtttattattcttaaaacatcaaatgtaagataaaaaggtttgactacttgaaaatattaaacttctgtccattcctaaataccaaaatatttctaacaagatcagtaccccaaccaaccagataattcataagacca

SEQ ID NO: 46385 - DNA, 410 bp, Homo sapiens
gggtctacacctgggcatttggtgagatcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattat

SEQ ID NO: 46386 - DNA, 405 bp, Homo sapiens
gggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaaataactcagttatggccatctacccctgctagaaggttacagtgtattatgtagcatgcaatgtgttatgtagtgctta

SEQ ID NO: 46387 - DNA, 355 bp, Homo sapiens
tagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaatttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 46388 - DNA, 332 bp, Homo sapiens
atccaaggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcaccgaaaaaaaaaaaaaaaaaaaaaaaaa

SEQ ID NO: 46389 - DNA, 419 bp, Homo sapiens
gtctcaaaaatacacgatctacacatactaagaaaaagcgattaggttttttccagacttatgatacagaatatttaaaagttggttttattatctgtcctggatcaaaagaaagttcaccaaggccacagtgtgcatttgtggagagatcttatccagtgaaaacatgaagccagcaaatctttctcatcatttgaagacaaaacattcagaattagaaaacaaaccagtagatttttttgaacaaaaatctttagaaatggaatgcaaaatagttctttaaaaaagtgttactagggtgaaaagtcacttgtgaaagcttcttatttaatgctttccaactgctgcagcaagaagccatctccttgctgaagaataattaaccatattagtagaaatgtgtcagaagtttgggtcaa

SEQ ID NO: 46390 - DNA, 168 bp, Homo sapiens
aaagggaaagacaggaagcctggggttctggtctgattccttccaacgggcacttcagctgccgaaagaaaccaagaagggaagcggccgctgggcccctcctgcgcacagtgttggtcaaggttcacatgggacaaataagtaaaaccaaatgagcaaaaaaaaaaa

SEQ ID NO: 46391 - DNA, 616 bp, Homo sapiens
ggggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcctagaaattctggatgggaagatatttgactaacagaattacgagataacttgggcaagcttacta

SEQ ID NO: 46392 - DNA, 482 bp, Homo sapiens
gggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcacccccttgccctcaataaataaagttcttttttaagttccaaa

SEQ ID NO: 46393 - DNA, 342 bp, Homo sapiens
actcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggttta

SEQ ID NO: 46394 - DNA, 297 bp, Homo sapiens
ggcggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgat

SEQ ID NO: 46395 - DNA, 440 bp, Homo sapiens
caatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgc

SEQ ID NO: 46396 - DNA, 401 bp, Homo sapiens
aaagaatccatacttgaactattattatgtatgttccgataattttgttgacaatacaagtgggaacaaatttctattgaagcaaacatctaattttcagttatgtccagaactctactttataatgttaaatgtagtagtatttcttaacttttaaatacttactactataggaattggtgctgaatcaaaatctctggagtgactgttagctgactaaaacctataccacttacacatcatttttccattcgtgtaaaaaacaaaatatcttaacacagtgaatactgctgagcagaattttttcttctcattttgctcaaaggaccagaatttccatgccctttatactcatacttgaatgagtctttttaatgttctcattttgctgtttttccacc

SEQ ID NO: 46397 - DNA, 663 bp, Homo sapiens
cagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttaattatcaatttttcccagtatttttatacgggaaaaattgtattgaaaacacttagtatgc

SEQ ID NO: 46398 - DNA, 310 bp, Homo sapiens
agatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactactttttcgaagtaatgctgctccttcctaaaagtctgttttc

SEQ ID NO: 46399 - DNA, 786 bp, Homo sapiens
aactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggcagggtatcttttaccagacctaaagcatatggagatagaatagaaagaatgctcgcctcagtttgacattgaccctgatgcaaaaggtggaagaagagcccgaagaagacctgagagacgccgaagacacaccagaagacacagagccaggacgaagatgaagaaatgggtgtgggaaccagatgaagaagaaacagccaaggaatctacagctgaaaaagaagaattggaaaatatacctctcaccatttgggatcccgggggggagaagggaatggggaaaatttaccatcaatttcttttttggggaaaaaaacttggtttgggatgccccccttaattcccctttttccccctggccctgggaaaaaaggggggaattatgggggccccaaggaaaaaaaaggggggtttttttaag

SEQ ID NO: 46400 - DNA, 460 bp, Homo sapiens
tggcggccggaggctttggcagctcgggactgagttcaagaatcagcatgattcttcagaggctcttgtggttctcctctgtcattcggcagccgctcacccatttgcggaggaacattggggttacagcagggcatttaataaggacttgatcctatacagaaactctttggggggcaagattaagaggaatacaaatctaagcgacagacatctggaggacctggtgatgctaggtcagagtatcagccaagagctggagagggagctttttaaagctcaagcaaatggttgggaatgcagacatgaatacattcccaccttcaaattggaagaccccaaatttgaaggcatcgaaaaaccccggcccgaagaaataaaggaaaataaccggggaattggccacggataagtggccactaggtagaagttcagaataaacatgccttcggaaaaaaaa

SEQ ID NO: 46401 - DNA, 147 bp, Homo sapiens
agggactgtcataccacgtgaagaataaaagggtgaagaataaaagggatatgatgacaaggttgatccacttcaagaattgcttgctttcaggaagagagatgtgtttcaacaagccaactaaaatatattgctgcaaatggaaaa

SEQ ID NO: 46402 - DNA, 310 bp, Homo sapiens
gtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccgggtagagttttctttgcttatgttgaattccattgcctcttttctcatcacagaagtgatgttggcatcgtttcttttgtttgtctgatttatggtttttttaa

SEQ ID NO: 46403 - DNA, 163 bp, Homo sapiens
attgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtc

SEQ ID NO: 46404 - DNA, 438 bp, Homo sapiens
tatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagcccctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggccttttgaataattgtcccaaatattacattcaaataaaagttc

SEQ ID NO: 46405 - DNA, 390 bp, Homo sapiens
atataaggattccttaaagcaaggaacatcataagtacaataaaaataagacaaaatctcgttcaaggagctgtctgtattcaacaccctgaaagttctgagctacatcaacagctggaacagtacagaaacactatctctcagggaggacagagtaccaggtaccaaatagatcctggcaaaggaacaggcatggaagtttccagagcacattcccatgctttatctctcttacaggttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaa

SEQ ID NO: 46406 - DNA, 432 bp, Homo sapiens
gactgacctgggaaacaacacacatgtccatcaatagtgttgtatcatacagtggaatactcagcaataaaaggaatgcactattgatatacacagcatggatgaatcataaaataattaggctaacttaagccagacaccgtcctttttcaaaaacgaataaatgctctgtgattacatttatataaaactttagaaaatgcaaaatacagaaagcaacagaaagcatattagtgattgcttggtgatggcgggaggaaggaacagatatgcaggagggaggaaattgcaaactacaacaaggaaacttttgagggtgaagaatctaataactgtcttaagtgtgatgatggttttacagatgtacacatatgtccaaacttgtaaaactatagtttatgcgctttgtcagttgtacctcaataaagtggc

SEQ ID NO: 46407 - DNA, 442 bp, Homo sapiens
gggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaacaaaaaaaaaaaaaaaaaaaaa

SEQ ID NO: 46408 - DNA, 548 bp, Homo sapiens
gagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaa

SEQ ID NO: 46409 - DNA, 588 bp, Homo sapiens
aacatgatgttcatcaagacctgtgcctgccagtacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcgagagactgagtcaagttgttccttaagtcagaacagcagactcagctctgaca

SEQ ID NO: 46410 - DNA, 295 bp, Homo sapiens
tgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaaaaaaaaa

SEQ ID NO: 46411 - DNA, 137 bp, Homo sapiens
  misc_feature 7, 10, 15, 16, 17, 19, 31, 35, 45, 46, 53, 56, 72, 75, 76,77, 78, 84: n = A,T,C or G
ggggacngtncctannnanggctccggcctnacgnggaaatggcnncaaaaanaangcaaaatataaaatanatnnnngacggntaggtttcgatgaacgtatagcgtacacgagcagaatgccgggagaagcatag

SEQ ID NO: 46412 - DNA, 269 bp, Homo sapiens
atccatgttaaggatagtccttatgtgttgtactcaaagtccactgatttaaatgttaatctcatccaacaaaacattcacggaaacattcagaataatgtttgaccaaacatctgggcactatggtccagccaaatttacacatcaaattattcatccttggctgggcatggtgctcacgcctgtaatcccagcactttgggaggcggcagatcatgaggcaggagattggagaccatcctgctaacatggtgaaccctatctctact

SEQ ID NO: 46413 - DNA, 397 bp, Homo sapiens
gagcaatctaggcgcgattcattttcaataactattcatatatggagtcaatgtctatacaggaagaacatatttcctatgttccttgtggttgatgagacatttcatcccaagtatgccttcattttctgccaagaatttttaattatcttaaactatttagtcacgtgttgagcacacagttgaaaaatggcaaaagtaatgccataaaatatttcctcaaaatatatgagttggggaaagtcagggaattagttctgtagtaccattggattagaaaatgaaataactattttgcccattcaaaggactctttcatgacattatatttatattaactatacggtatacatggcatgcatatatatatgtatacataaccttttataaaggatct

SEQ ID NO: 46414 - DNA, 456 bp, Homo sapiens
aagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacactttctataaaacttgaaaatagcaaaaaccctcaactgttgtaaatcatgcaattaaagttgattacttataaatatgaactttggctcactgtatagactgttaaatttgatttcttattacctagtgttaaataaactgtgtgagact

SEQ ID NO: 46415 - DNA, 292 bp, Homo sapiens
agtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgaaaaaaaaaaaaaaaaaaaaaaaaaaaaaaaaaaa

SEQ ID NO: 46416 - DNA, 564 bp, Homo sapiens
tttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctccgggcacctctaaacacacccaaataactcacaagtactgatttaacactcggtattacggaacttctttgaactattttgaactttgaatctcttctctgaataacggccgaaactcaaagataataattagttgatgaaggttatcaattaataaaataacacagaccagtcttacca

SEQ ID NO: 46417 - DNA, 640 bp, Homo sapiens
atggattaaaaactttaagactttaaatgtgtatgaagttggacttggttttccaggctcaagcaattcttctgcctcaaccttctgagtagctgggaccacagacctgtgccagcatgccctgctaatttttgtatttttagtagagaggaagtttcaccacgttggccaggctggtcttgaactcctaacctcaagtgatctccctgccttggcttcccaaagtgctgaggtatgaggcatgagccattatacctgggcaacattttcgttattttaaaaatagttttagtgcatgtattggaaatgttatatgattagtttgctatttgtaaagttacacttgaccatctttagaatccccgaaggcaaaagtattggttccccattgaaggacatggtgttatgtcttgcatgggcctcttcttttgtgcatttttccctccagcagggtctgaattatccaaacgtagtctcatgtctggattggaacaaatggaagagctgaggacaggagtgacaaggagttctgcaggggagaagaaagcaatactgcagagaaacggtatgactctaaccaattctgggaaaagtcttcaaatggaacaacccattttcttaaggaaccccacaatggaaa

SEQ ID NO: 46418 - DNA, 418 bp, Homo sapiens
gatgtgattgaagagcatggtccttcagaaacggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaagaggagggatcctgaagaaatcatatgttaaacatactttgacacctactgtgttataaaatatatcatcagatgtgccttgagaatagtatatgtaacattaaaaaaaagttgctggcc

SEQ ID NO: 46419 - DNA, 609 bp, Homo sapiens
gtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggtttgcttctgtctgtctgttaatgggaaacttgtacttcaagtaggggggaatcctaaattctaaataactccttaagcctaagtttt

SEQ ID NO: 46420 - DNA, 622 bp, Homo sapiens
gtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttttgttcctgctagaaacccagtgtagccaaggcaagatgtcaataaatgcatactctgtattcgg

SEQ ID NO: 46421 - DNA, 379 bp, Homo sapiens
aaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattca

SEQ ID NO: 46422 - DNA, 563 bp, Homo sapiens
ggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggttctatcaatgtgaaataaaatttaattctaa

SEQ ID NO: 46423 - DNA, 620 bp, Homo sapiens
gaagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagcggttccagcttcctgggaacataggttttgattgtcacctcaatgggactgcttcacagaagaaaagcctggttcataaaactttgcctgatgttctagcagaacctttatcaagtgaaaagacatgaagtttgtgatggcacaatatgtgaatgaatttcagggtaatgatgcacctgttgaacaagaaattaacagtgcagaaacttactttgaaagtgccaaagtagagtgtgcaatacaaacatgtccaaaaattgctgcgaaaagatttttgaatcactgtttccaagaagtaacctaaagggcaaaactaatggattccggaccggtaaca

SEQ ID NO: 46424 - DNA, 248 bp, Homo sapiens
cagctgtcattgctggtggagttattggctttctctttgcaatttttcttatcctgctgttggtgcatcgcatgagacagaaggatgaaggaagctatgaccttggagaacgcaaaccatccagtgctgcttatcagaaggcacctactaaggagttttatgcgtaaaactccaacttagcgcctctatttatgagatcactgaacttgtcaaaataaagctcttgcacaagaataatgaagaactct

SEQ ID NO: 46425 - DNA, 407 bp, Homo sapiens
aggagtacaataaaactgttgtcagcttttgttttacagagaacgctagatattaagaattttgaaatggctcatttctacgtgctgtgcattttaaccaataatctgatgaatatagaaaaaaatgatccaaaatatggatatgattggatgtatgtaacacatacatggagtatggaggaaattttctgaaaaatacatttagattagtttagtttgaaagagaggtgggctgatggctgagttgtatgttactaacttggccctgactggttgtgcaaccattgcttcatttctttgcaaaatgtagttaagatatactttattctaatgaaggccttttaaatttgtccactgcattcctggtatttcactacttcaagtcagtcagaacttcgtagaccgac

SEQ ID NO: 46426 - DNA, 221 bp, Homo sapiens
catttatcatggctgcaagtaacttcaaaaggatggggaagcgcgatcttggcatgtgccagaagaaatgaaaccatttgggaagagcattaatgactgtctttacaggaaaaaagcaatcaaatagacatgatttcttgtttcagctcatcatttcctactgtgaacctaaactttctgagccccagttcttattctaaaataaaataatgattgggatg

SEQ ID NO: 46427 - DNA, 547 bp, Homo sapiens
gagaacatttacattatagataagtagtacatggtggataacttctacttttaggaggactactctcttctgacagtcctagactggtcttctacactaagacaccatggaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcacaacaataaaattaaggaaatcaaagaaaatgattttaaaggactcacttcactttatggtctgatcctgaacaacaacaagctaacgaagattcacccaaaagcc

SEQ ID NO: 46428 - DNA, 678 bp, Homo sapiens
aatgttataatagaaaaaaagagcattacacaatgaaaaaaatagtccacttaaaagctgtaacagttataaatacttatgcaccaaaatacagagctcctaaacatatgaagcaaacattgagagaattgaagacagaagtagaaagcaacacagtaagaataggatactttactactccacttttaataataaatataacaaccaaacagaatatcagtaagaaaagagggcttgaacaacaatgtagatcaattggaccttacagacatatataggatattttacccaacaatagcaatggtacttcttaagtacacatgaaacattattcagtatcaaccaaatattaggccactgctgtaatctgaatatttgttcttccatagctcatgttaaaatttaactgacattgtaactgtattaaaaggtgggaactttgggaagtgatgggtcatgatggccccacccacataggtaggattattgctgtcatcagagaaagagtttaacccccctttaaccttttggccctccccctttgcaacaaggtgatgacacagcaaaaagggcctcaccaaatattgggggctttggcaattggaaattcccaaacctccaaaatcctttggatcccaataaaatttctggtggattggaaaatattaatttcccggt

SEQ ID NO: 46429 - DNA, 318 bp, Homo sapiens
cacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgc

SEQ ID NO: 46430 - DNA, 280 bp, Homo sapiens
attttacactgactcaaaccagcagccaagttggcggatagttcagaagatgagtgctacagccatacgagtctaattcatggacccctggcagaagcttttgtaaccaataggaaatacatttttcgtaaagaaagaagagctaatatttagtataggagccaaaataaagaacttaaaaccatttacatggatttttctagctagcaattagaaaaggggcttgagatttgagggcagcttatattcttaggggtgtggaggaagacagatgataaat

SEQ ID NO: 46431 - DNA, 234 bp, Homo sapiens
atgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccaaaaaaaaaaaaaaaaaaaaaaaaaaa

SEQ ID NO: 46432 - DNA, 546 bp, Homo sapiens
aactcggtggtggcactgcgcagaccagacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcaatttaatcagagtgcca

SEQ ID NO: 46433 - DNA, 365 bp, Homo sapiens
acataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctgaaaagaaaaa

SEQ ID NO: 46434 - DNA, 203 bp, Homo sapiens
ctccaacatgtcaacagtattttcagaataaagactatgaaatatattgctgtagtggaaaattctggtcctttgtctttaatgtctttttgagtggataaagaaaattcacccggtttgtagtttctatatttccgtgaatctttgaccttgcagtgggttgcaataaaagagtagaaaaaaaaaaaaaaaaaaaaaaaaaa

SEQ ID NO: 46435 - DNA, 624 bp, Homo sapiens
ggaacaggtggtaggcttcaggaatatccagttttaatcagttgcatttggtacagaattttgagtaatggtgaaaattgttgtctttggaaagcacaaaagaaacctggaaaggcagttcggctcaggtagctacacataacattgtgtatgattttcgcttcaaagctgtctggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaagaaactgtcgagcaagttatataacaactaacaacattgcactttctgtatatgaaatcaatatttaaataacttatttttctccatgctgttctaaaaacattgtaagtagctgtaatataccagtaccaatatgtctgcaattgc

SEQ ID NO: 46436 - DNA, 540 bp, Homo sapiens
ttcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgagaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaggggtataataatgttaacatggacatgatcttctt

SEQ ID NO: 46437 - DNA, 358 bp, Homo sapiens
gaaacaatttgggagaagatagaagtttgaagtggaaaactggaagacagaagtacggaaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagccaagtattggagaagtatagaagatagaaaaatataaagccaaaaattggataaaatagcacta

SEQ ID NO: 46438 - DNA, 130 bp, Homo sapiens
ttttttgcgtgtggcatgttttaagttattagtttttaaaatcagtactttttaatggaaacaacttgaccaaaaatttgtcacagaattttgagacccattaaaaaaaaaaaaaaaaaaaaaaaaaaaa

SEQ ID NO: 46439 - DNA, 618 bp, Homo sapiens
gtggtggccactgcgcagaccagacttcgctcgtactcgtgcgcttcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcccggcaatatgtctgtacattccacaagcattgccctcttattttacttcttttagctggttaaccttggaagatgccaagagggtggatcaaggttaaatgactgggcctgccctttcacatcaaagaactctggcacgaaggccgggcctgcctttcccatctggctatctatctggctggcagggaaaggaaaaacctgcatgttggggaaaggaagaaaagggggtggaaaaaagtgggggtggggccgacccgggaaaactagaggtaaaacccaacctgggcccaaggggtgcccggcaggccggtaatgcaagtttaatcagaagtgccccttttttttttgggccaaaaggaattttaaattattgggaaaggcaccaattttttttaaatttgcc

SEQ ID NO: 46440 - DNA, 151 bp, Homo sapiens
gtctgaaggtgatatacatatcaatgatgatgctgctctaggtatcacaatcaattgtgcttctggttagacttggccccatgtttcctgtgctccctcagtccaatgtctctgccacctaaaggggattaatttttggtcttaacaaaac

SEQ ID NO: 46441 - DNA, 162 bp, Homo sapiens
aaacctaactgcaatgtggatgttttacccacatgacttattatgcataaagccaaatttccagtttaaggaattgtctacaataaaagaaattttgcctgccacttttcaggattatcttttgaaggtttctgttgatgttaactgagctactagagatat

SEQ ID NO: 46442 - DNA, 197 bp, Homo sapiens
atcatgtcgcacaaacaaatttactattcggacaaatacgacgacgaggagtttgagtatcgacatgtcatgctgccccaggacataggccaagctggtccctaaaacccatctgatggctgaatctgaattgaaggatctttggcgttccaccagatcaagggatgggtgcccatatatatatatcaagagaccca

SEQ ID NO: 46443 - DNA, 158 bp, Homo sapiens
agtcacattgggatttggagcttcaacatatgaattttcagggttatcattcagtccaaagtacttaatatgattcttttccgtttccacatagacaatcacataatctgtaaataatggctcttacttttccactttagtcggtagggtatacccat

SEQ ID NO: 46444 - DNA, 201 bp, Homo sapiens
atttacatccgtctgtgttaaaataatcaaacggaaaatcagccctgtgttgtcagcatgattcatgtatttatatagggttgattattttaattttcccggctcttttttttgtaaaatttatgtacagaattgatttttcataggtttaactagatttccaaggtatattttggcatattgttttcaaccctaaatttg

SEQ ID NO: 46445 - DNA, 258 bp, Homo sapiens
ttggtgtacaaaactttttatatcaaaaggctttgcacatttctatatgagtgggtttactggtaaattatgttattttttacaactaattttgtactctcagaatgtttgtcaaatgcttcttgcaatgcatattttttaatctcaaacggttcaataaaaccccttttcaggtataaagggggttactttcaaattgtggattcagaaaaactcaagagtttaggtaaaaaagagggtttggccctgggacagaac

SEQ ID NO: 46446 - DNA, 202 bp, Homo sapiens
gaaatgtgccttaggaaagtaaagagaggagagcaatttaagcctcaagtaagcagaagaaaagacataaaactttgagcagaaatcaataaaattgacaacatgaggtcaacagagacagtcaataaacccaccaggcaatgcctttcagggatcaataaaatcgatatatacatagccaggctttccatgtgagagaggg

SEQ ID NO: 46447 - DNA, 190 bp, Homo sapiens
gaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaccctgacggaggttgagactgaagg

SEQ ID NO: 46448 - DNA, 170 bp, Homo sapiens
acggtgtaggccgctgcaggccaccatgaacccgcttccggatgactacgacccctacggggttgaagaggctagcgacgaggagccgggttttagaagctcttaggatcaaggtgtttttcttttacaatggaacttcccagccaaaaacgggaaactttatcagagag

SEQ ID NO: 46449 - DNA, 173 bp, Homo sapiens
aaataaacataagctgtgtttccccataaggttttttaaattgtatattgtatttgtagtaatattccaaaaggaatgtaaatagggaatagggtgatgcttatgttaagtcccaacccatacacagaggaggattgggaggccggtcacaattaaatttcacatttttcccc

SEQ ID NO: 46450 - DNA, 212 bp, Homo sapiens
agaggaacacgaaagcaaatggcagtagcctgagacggctacttctgtgttgttgccactcatctgaagctgtgagtcttgcctttgacaagcttttttgggacagaggggcccaaggagctgtagaggggcaatcgcttaagattgtgggattgagctctttagggtactcggtgaaaggattctcgagttttgccccgcacacacgctca

SEQ ID NO: 46451 - DNA, 201 bp, Homo sapiens
aaggaaatagcaaattcacctacacagttctggaggatggttgcacgaaacaaacttgggaatttgagcaaaacagtctttgaatatcgaacaggcaaggctgttaagactacctattgtaggtatttgcaccccataacaattgggggcccaatcaagaattttgtgtgggacgtttgcccctttttctttttatataac

SEQ ID NO: 46452 - DNA, 152 bp, Homo sapiens
ctgtattgccgcagttctagcttcaccttcacgatgtttcccttggtcaaaagcgcactaaatcgtctccaagttcggaggattcagcaaacaattgcaaggcagggccacccagaaacggacaacttattttaatgacaaatacgggaatt

SEQ ID NO: 46453 - DNA, 214 bp, Homo sapiens
ctgaatgcaatggagtgtgcattacatttgggaaaaaatgtgaatcagtcactactggaactgcacaaactggccactgacaaaaatgacccccatttgtgtgactttattggggcaaattaccccaattaggaggggaaaggccttaaaggatttggggaaccccgggacccactttcggaagagttggggcgcccccattttggtttggggg

SEQ ID NO: 46454 - DNA, 199 bp, Homo sapiens
ttatcgacacagccgctcaccatcgcgaagttgacccaacgagataaaggtgtttcctaggtcaccgaggtaaggtgggtccaattttccctggccccaagaatggcccctgggtttttttcaaaaaagtgggtattacaattcaaaggaaggggtttcattgaagggcctgggtttaaaataaaataccacttaggca

SEQ ID NO: 46455 - DNA, 231 bp, Homo sapiens
ataatttttattgcattttactgtacatcacaaggccatttttatatacggacacttttaataagctattccaatttgtttgttatattaagtgactttatcaatacacaaggttttttttgcatatgtttccttcggttaaacccagtttcataattggttgtatatgtagactttgagtgtttatctttttccctcttttcccacgggagctctaacccctatgagggg

SEQ ID NO: 46456 - DNA, 107 bp, Homo sapiens
ttaatgacttctggatcctgagctccctttgcagtctgaaaaaggtattgcagtcagaactgtgtactgatgataaaagcctctggtagcaataaaaagttgtcctt

SEQ ID NO: 46457 - DNA, 274 bp, Homo sapiens
agcagtttattccagtatcacccagggtgcagccacaccaggacttttttgaagggtgttttttttcttttaaatgtaataccttctcatcttttcttcttacaaaggtgtcttaggacaattaaaatattggttaggaggacacatggtggttacctctctctctttagggggggctctctctctctctctgcacagtcctgggactgggtcttctacactagggacaccatgaggggggtatgtgctcctattatccctggctttgtgctct

SEQ ID NO: 46458 - DNA, 246 bp, Homo sapiens
gcttcacttggacaacaacaagcttaccagagtaccttgtgggcttgcagagcataagtacatccagggtgtctaacctcaaaacaacaatacctttggtaggtggggtcaaggaaaatctgccccacttggcacacacacaccaaaagggttttttaatttgggggttagggtcttttagagaaacccgtgtcccattcactggggagaacacacccatcccccctcaaagatgtgtctacgacg

SEQ ID NO: 46459 - DNA, 222 bp, Homo sapiens
cacaattggcaattgcaaaaacgtggaaccaacccaaaggcccatcaatcaatgcgtggataaagtaactgtgatatatatacatacaatgggatacttctaaggcataaaaaggagttaattaatggcattcccaattacccggataaagagtttgagagatatataatctatagttaaaaagaccacaggatttggaaaacccaacacacccgttgtgat

SEQ ID NO: 46460 - DNA, 180 bp, Homo sapiens
cggattacaccttcccacttgctgaaaaggtcaaggccttcttggctgatccatctgcctttgtggctgctgcccctgtggctgctggcaacacaggtgcttctgctgctgctggaggcccaactaaggttggaggcaagggaggtcgcgagagagatctcgcccagagatatatgggta

SEQ ID NO: 46461 - DNA, 268 bp, Homo sapiens
  misc_feature 236: n = A,T,C or G
aaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgacccatatatgattttctttaaggatggtttagaaatggaaaaatgttaacaaatgtggcaattattttgngatctatcacctgtcataataactggcttctg

SEQ ID NO: 46462 - DNA, 175 bp, Homo sapiens
cattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacgg

SEQ ID NO: 46463 - DNA, 202 bp, Homo sapiens
cagcattcgggccgagatgtctcgctccgtggccttagctgtgctcgcgctactctctctttctggcctggaggctatccagcgtactccaaagattcaggtttactcacgtcatcccgcagagactggtaagtcaaatttcctgaattactatgtgtctggggttcagccatcccccattgaagtggacttactgaagagt

SEQ ID NO: 46464 - DNA, 213 bp, Homo sapiens
atttgtaaatgtcttttcaaaaggatttacttttggtaaaaagcttcattctcactctgctttgcatcccccagacttcttgttcaaaacggggggagtttaggagactttaatcccggtttcagaagctgcagctggtctgtttccaggtcagaaaccattgttcagaagacctccctgtgagagaggttgctccccagggtccctcaggac

SEQ ID NO: 46465 - DNA, 256 bp, Homo sapiens
ttggagctgcctttactgatgatggctttgcatgggtgtggcttacattctaaagcttttggatcagtatcgggagtttgattcacttcactggttccagtcttttagagagaaatacctgaaggagataagagcagttgctaagcaacagaatgtacagtcagccagtcaagatgaaaactcttacaaaccatggatctcactcagaagcgactcgatgtctatctacaaggatttgaattgctgtatttctcac

SEQ ID NO: 46466 - DNA, 243 bp, Homo sapiens
  misc_feature 33: n = A,T,C or G
ggacagaattcttaccacagcaaaggcataagntgcttgatacggaaaatcagaaacttaactcttttgttgcagatagtcatcagtggctctgtaaaaacgcagaggaaaagagccagaaggtttctgttttaatgcatcttgccttatctttttttattactgtgtacaaagatttttttacacaaagaaacttaatgctgtattaataaaccagggtgtagcctcaattggggtagttcc

SEQ ID NO: 46467 - DNA, 243 bp, Homo sapiens
  misc_feature 18: n = A,T,C or G
cggcaggatggatgtggntaccccgagcggcaccaacagcggcgcgggcaagaagcgctttgaagtgaaaaagtgggatgcagtagccctctgaggccttgggatattgttggttgataactgtggccatctgcaggggtccacattatggggtctttgcataggatgtcaagctaaaccagggggtccgctacttcaggagagtgtactctcgcattgggagtctgtaaccatgcttttcac

SEQ ID NO: 46468 - DNA, 270 bp, Homo sapiens
  misc_feature 33: n = A,T,C or G
gattatactgcaggcagcttcagccatgttgtnaaactgataaaagcaacttagcaaggcttcttttcattattttctatgtttcacttataaagkcttaggtaactagtaggatagaaacactgtgtcccgagagtaaggagagaagctactattgattagagcctaacccaggttaacttcaagaagaggcgggatactttcagactttccatgtaactgtatgcataaagccaatgtagtgcagattctaagatctatgtgtccaag

SEQ ID NO: 46469 - DNA, 394 bp, Homo sapiens
ccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaatttaaaagtggagcattcagacttgtcttttcagcaaggactgggctttctatctcttgtactacactaaattaacccccactgaaaaagatgagaatgtcttcccgcgtgaaccatgtactttttaaaagcccaggatagttttggtggtcgagaaatgtaagcagcatcattgaggcgtttgagtccgccc

SEQ ID NO: 46470 - DNA, 199 bp, Homo sapiens
aaaaccaatagctttaaaactgtgtgccattttaagagttacttaatgtttggtaactttcatgccttcactttacaaattcaagccttagataaaagaaccgagcaattttctgctaaaaaggcttgatttagcactatttacatacaggccatactttacacagtatttgctgaattgggagcttttttgagttgag

SEQ ID NO: 46471 - DNA, 106 bp, Homo sapiens
aggctgaggaaggataatcgctggaacccaggaggcggaggttgcagtgagccaagattgtgccactgcactccagcctgggcaacaagagcaaggactccatcgc

SEQ ID NO: 46472 - DNA, 186 bp, Homo sapiens
catcactttattgactcctagccgcagacctcctcattctaacctgaatcggaggacaaccagtaagcgtacccttttaccctcaatttgacaagaagaaatccctactatatattcacaacaaatccaaatccaaaaaaccactaatttccccaaattgagaacaaaatatataaaatgggccgc

SEQ ID NO: 46473 - DNA, 213 bp, Homo sapiens
ccgcttgccttgctctcagaatcgctgccgccatggctagtcagtctcaggggattcagcagctgctgcaggccgagaagcgggcagccgagaaggtgtcccaggcccgcaaaagaaagaacccgaggctgaagcaggccaaagaagaagctcaggcttaaatttaacaaaaccccctccagagggggaaagatttaagcaaaaagctgtcgc

SEQ ID NO: 46474 - DNA, 235 bp, Homo sapiens
attgtcacattcataatgctgatacttacatgtaaggtgttcatgttgcaggaaaaggttatacgtaccacggattctctttaatattgtacagttaaactgtatttctgatgttgcaagccattttgttttttcattgtacataggcacatatgtctctttaaaatgctgctgcaaaatgtagagagtatagcccccaacagaaattataacacccacagctttaagtgttata

SEQ ID NO: 46475 - DNA, 383 bp, Homo sapiens
cacctaaggatgcacaatttttatcagagaagcggtcaagaacttcactgaggtccaccctgactacggggggccacatccagggtttttttgggacaagtacaatgctgagaggcctaagattgggattcacacactttgtgcagtccggttctcacttggcggcaagggagagggcatatctttgagggcgcgggccctgcacctcgtgcagaggggtcagcgttcatacctgtaacccgctcatcactggatggagattattcctctcctgtatgagcacacaaaaatggggtttcaacatagggtatacccctttttgtggagtctgtgtgagattttgagatatttcccgcgggcgtatggggtgtggtttttagcac

SEQ ID NO: 46476 - DNA, 115 bp, Homo sapiens
aggtacagaatctaatgtggggataaatactcaaaagaagatatgacccaaacgagggaaagatagttatagtatactacctggtggtattgaataatgtaattagttagtcata

SEQ ID NO: 46477 - DNA, 107 bp, Homo sapiens
gcccccttggccccaatcgtttttgggttgggaaaaatttttaatttggccccaaaattgggagattatttttgccatttttttttttttttgaggggggggggaaa

SEQ ID NO: 46478 - DNA, 118 bp, Homo sapiens
aaaaatttttattataaactggagtaaacgaggaaaaaggggcccccccccccccttcttatcaatttcaaactaaatggggggtactacgtgtggctgcctcccccccctcaatcca

SEQ ID NO: 46479 - DNA, 242 bp, Homo sapiens
gcagaattgtaactcggggttttggcctctatattgagtgaccaaatgccaaaattgtccatctgcctctgagtagggcaatggaaataccaaaccttctgactttgccaaaaaggataaaagaaacctggtcatacatagggtgacaaaattctttctggttgtttttaaacaataaagcaataagggcaatacaatacatagggggtttaaagcccaaaggggtgcccttctttatattt

SEQ ID NO: 46480 - DNA, 102 bp, Homo sapiens
agccggggactttgggccttatgtaccgggcaatgcaggtctggcaaacatattgctagttctagattccttatttgtttttgggaccacccacccacaaac

SEQ ID NO: 46481 - DNA, 281 bp, Homo sapiens
ttgcttgcttttaaatattgatatgcttatacacttacactttatgcacaaatgtagggttatattaatgttaacaagggcaaggttcttctttataaatccccctttgaggtcctgctcacggttggtggttcttggcggggttgctccagggaggcttggaggggcctggaacttgagggggggaaggacgagagattttctctatataccacataaaacatctgtgagagatgtgctctctactctctctcaccctcagagctcttgagagggatgag

SEQ ID NO: 46482 - DNA, 166 bp, Homo sapiens
actagatttcaagctaattttctttttctgagctctacacatgaatctagttcagagggaggcaaaatcccttaatctatgtacaccgcttgggaccactgccttaattaaggagttaaaaacgggttaatagagaatatttttggccaattcccctaatggtgtg

SEQ ID NO: 46483 - DNA, 117 bp, Homo sapiens
agctagatactggaaacctaactgcaatgtggatgttttacccacatgacttattatgcataaaggccaatttccagtttaagtaattgcctacaataaaaagaaattttgcctgcc

SEQ ID NO: 46484 - DNA, 263 bp, Homo sapiens
actgtacacactttatttacttcgttttggttaagttggcttctgtttctagttgaggagtttcctaaaaggtcataacagtgccattgtctttatatgaacatagactagaggaaccccccccctttttccatcataattcttatctaacaatgggagttttgtcccctttacactttttgaggctttttggggggggataaataacccccctctttgctttagacacagatatttttccccaaagcacctattttttccca

SEQ ID NO: 46485 - DNA, 222 bp, Homo sapiens
ccggggtggtgtgggtgatgggactcattttagaaaggaagccttgctcattcttgagggggcattaaggtatttcggaacttccaaaggtggcttggtggcggaatgggacactaatttcagccacgatttggggaataaattttgctttatagtatattggaggcacaaatttactctctttcatttttggggctctgtggggaatgtggatggacttct

SEQ ID NO: 46486 - DNA, 170 bp, Homo sapiens
tcacccagctccttcagctgagcgtaccatccagcagtgttgtgaaaatattctgctgaacgctgccttgctaaagcgagatgcttgagagcatccaccagtaccttcttcagcggaagggctcaccacccacagtgtttaattctgagggggccgccatattgggttct

SEQ ID NO: 46487 - DNA, 211 bp, Homo sapiens
ttgattaaggaggaaaattattgtgttaagagattatggcagttattgatatttattttccccccggggtgtagggaggcgtttttattgctcttaggctctggtccagacctgaaggttttaggggtctgcaaagttgggaaggggcgggagacaatgagggtggggagagcactggtatacgctgggccctcacagagtttgagaggac

SEQ ID NO: 46488 - DNA, 154 bp, Homo sapiens
aaaatattcaataaaatactggcaaaccgaatcagcagcacatcaaaaagcttattcccccatgatcaagtgggcttcatcccttggatgcaaggctgtgttcaatatacacacaatcacataaaatgtaatcccggcctatataacagagacc

SEQ ID NO: 46489 - DNA, 265 bp, Homo sapiens
accatgctaaagagcttgtggccaaaccagcagaacattcttctcttcaaaggatgcaatagtagaaagctacttattttaatgaaaaagagaaaaacttcgttctttatcagcctcatgcctgaatcaaatttttaattattctgaaactcctgctgtttagagttatatataaaggggcgcctgagctaaggtaaggctcgggctaaactcattttcactctttgtgttttttggtggggggcaaggggttctctatacaaaa

SEQ ID NO: 46490 - DNA, 270 bp, Homo sapiens
tccgattagccttttctctgcttgcttgcttgagcttcagcggaattcggaattgcttgccgtaaggcttggaaggacttccgaaaggccaagacaaaggcgcgttttccccttgcagagagccccgctttcagtgttccagtgtgggcgtgatttaatatgagcacacctaaatttttggggcgcgcccccctatatggcgcgtgtggggcgcgtttccctctgtttaacagcgcagccatccctggttgtctctccaccgcagaggta

SEQ ID NO: 46491 - DNA, 241 bp, Homo sapiens
aactaatatttaaaatggctacaccaaacaaggcaacttcttggtcttaccccaggaggttggaaaggcttggacgttccgggaaattggttacacagctgtttggtacactctaatctcgcaacccagggtttgggagtggctcagtcccgcagataacactctagaaactcattgcgcactcagatcggctccgggcctcattttagtgaccatcctacttcagaggagcacaccagtg

SEQ ID NO: 46492 - DNA, 221 bp, Homo sapiens
atttaacatgaatcttgagtacgtggacattgcttgaagttaaactcttttgttttggttttgtttggtttggttttgaattttagaactccagaatatcctaaagtttaaatgggtgtggggctgtgggtgttgaaccttggggagaggcactgggagaacgacgttgaaaggtttagggaatactaatgtggacgcgctggtgggaaagtagcacattg

SEQ ID NO: 46493 - DNA, 293 bp, Homo sapiens
ttgcccaattgagtgcttcatgccttagatgtaccaggctacagagaggatttcccgaggagaaaaattcattctttccaattccaggaggaccaagacatgttctctctgccagagattccattctaaactggaggtgagtgttagacagaccccacccttagagtttctccttctcttttctaaagcccctttgtctctgggagggaaggttctccagctaaagctcaatctcacagctttctccaaggatcacccttgggagtttccccgagggtttttctcatatatga

SEQ ID NO: 46494 - DNA, 267 bp, Homo sapiens
ctgtgctgcccctttcacatcaaaggactactgacacgaggccgcgctgccctttccaattgtcttattattttggctggcagggaaggaaagaccttcaatgttggtgaaggaagaagtgggttggaagatgtgggttgggcacgacagtgaatttctagagtaaacccaggctggcccaaggtgtcctccaggctgtaatccagtgtaatcagagtcccattttttttttgttacaaatgaattctaatttatgggggtgcacac

SEQ ID NO: 46495 - DNA, 265 bp, Homo sapiens
  misc_feature 233: n = A,T,C or G
ttctttgaatcctagccatctgcagagcaatgactgtgctcaacaaaaaaaggtaaccctttccttcttgaataggccaattccgaaataggaaaggccctcctatattttaactccctaaccctggtaaagaacacacagattttatttttatgagtcccaagaggatgaaaaaaatttttatacgttagataaacactataataggtcattgattagcctgctgcgaagcnattgggttaaagaggaaaagtgtatagcaaga

SEQ ID NO: 46496 - DNA, 296 bp, Homo sapiens
  misc_feature 259: n = A,T,C or G
ccttttgcaaaggatctccttcatccctcttcagaagaggagaagaggaacacaaggaggaacggcttgtgcaggaggcccaatttctaattaaatggtgttaaattgcccgaggtgtgttttaaaattacacacggggtttttgggcaatgaaacaaacggtaaatttttgtgttgttggtttgcccacactctctctctgccaagccctacgggggggaaaaggaaaggttttagaagcaggggatgttccctcganggggggaggcgaccacttaaaagcactctgtagtcaa

SEQ ID NO: 46497 - DNA, 279 bp, Homo sapiens
  misc_feature 246: n = A,T,C or G
agtagcagttgtaaataatttatgaatgacagtacacattaaaaggtatgcattagcagcatattaggatccttttttatttgctgaaggaaataaccgtctttctattttaaaagatacaataaggacgggggtttaggtcgtagagagtctcaaaaattttgtttactatctcccactgtgggtgaaaaatttattaagtttctaccatgttccctctctctggccctataacaccccctccangcgggctggggccacgctttgtgctctctctgg

SEQ ID NO: 46498 - DNA, 147 bp, Homo sapiens
taattaaataaaattcccaaaagatgaaggtccccggtaatgtcctttaagagagtacaaggccgatcaagaagaaagagagcccctccgaagaaggaaaaaacaattctttttccaaaacccaaaggaggggacaaacgcaaaagg

SEQ ID NO: 46499 - DNA, 181 bp, Homo sapiens
aacatagggagaccccatttctacaaaaaaactgaaaaattagctggctgtgttggtgcacgcccatagtcacagctactccagaagctgaggtgggaggatctcttgagcccaggagtacaaagctgaagtgaactaccactgcacttcagcctaggcgacagagcaacatcctttcttt

SEQ ID NO: 46500 - DNA, 162 bp, Homo sapiens
aacatcctgctgcatgacctatcagtatggtgctaatgtgtctgtggaccctcgccctcttgtctccaggcaggtctctcggatactttgaatgttgtgtaacaggtagccactcctggtgtttatgttaacattcctatcaattcaaatttcctctggagt

SEQ ID NO: 46501 - DNA, 178 bp, Homo sapiens
acttctcgtccagtgtgtgactcagtaggaggtcagagtttgatttccacaaaaaaaatcatatgactacaaattgacttcctgaaatattgccctttatattgcacaataggtactgtcctaatgggaaaatgaccaaaatgctgaattagaacaggtggacatcaaaacaataagg

SEQ ID NO: 46502 - DNA, 171 bp, Homo sapiens
agccagtcgtagttctttgtaatcctctttcttccaaacctgctttgctgaaagttgcagaaaaggaagtgtgtggagagaaacagaacccttcagggtgggtcagaggacgccatccacagtggattcgtgttcgtttgcaggtggaagcagttatttttaggacccact

SEQ ID NO: 46503 - DNA, 188 bp, Homo sapiens
cgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgcaagttgactttactaag

SEQ ID NO: 46504 - DNA, 175 bp, Homo sapiens
aggaaaggaaactttgaaccttatgtaccgagcaaatgccaggtctagcaaacataatgctagtcctagattacttattgatttaaaaacaaaaaaacacaaacaaatagtaaaatataaaaacaaattaatgttttatagaccctgggaaaaagaattttcagcaaagtacaaa

SEQ ID NO: 46505 - DNA, 174 bp, Homo sapiens
tcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctttc

SEQ ID NO: 46506 - DNA, 174 bp, Homo sapiens
aagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttccctaccttgcaacaaaa

SEQ ID NO: 46507 - DNA, 167 bp, Homo sapiens
gcgtttgccgagggctggcatagatttggctgtctcgctcatagctgcttttggccgcgaaagatgccgggtcttggttgactcaaacccttccccgcctttagtcttaaggagaagaagccgcttaagccctcctgcgctttcccggagaccaaaaaaggcgcgcg

SEQ ID NO: 46508 - DNA, 260 bp, Homo sapiens
ccttaagaatcactataaaatgcaataaagttactcaaatctgtgaagactgtatttgctataaccctattgggtattgttcttgtagtaatttaagaggtggatgtttgggattgtattattatctcactaatatctgtagctattttgtctttggctttgggtatagtttcccccctgtctgaggtatgagctgaacattgctcctcctcacctcctgccatgatactgtcagttacccggaggtaacaagctgatat

SEQ ID NO: 46509 - DNA, 269 bp, Homo sapiens
ccatatcttaaagaacagctttcaagtgcctttctgcagttttcaggagcgcaagatagatttggaataggaataagctctagttcttaacaaaccgacactcctaccaagatttaggaaaaaagtttaccaaccataatctagtttacagaaaaatcttgtgctagactacttttccccgggtattttgactaccattaaacctgcttttttttttcccggcaaggtatccaccaccttggttctgcttcaataaatctttggaaaac

SEQ ID NO: 46510 - DNA, 259 bp, Homo sapiens
  misc_feature 227: n = A,T,C or G
atcaataggaaagcatattcagccaaccaagatgcaaatgtcttgaaatgatatgaccaaaatcctaagtagggaagtcacccaaacacttctgctttcacttaagtttctggcccgcaatactgtaggaacaagcatgatcttgttactgtgatattttaaatatccacagtactcactttttccaaatgatcctagtaattgcctagaaatatctttctcttacnctgttatttatcatttccccccagtattttta

SEQ ID NO: 46511 - DNA, 275 bp, Homo sapiens
caccccaaagtgcacaaagctgagtaaaaagctggccccttcaaacagaactagactcagttttcaatttcattctaaaacttcttttaaccaaggttagcttctcaaaggcctaaccaaggctttgcaccgacagatcctttctgtaggctaattctcttgcccaacggcatatagagtgtccttattgctaaaaaggattccgtctccttcaaagaagttttattttttgtccagagtacttttttttccgatgtgtccagccagctccgcag

SEQ ID NO: 46512 - DNA, 257 bp, Homo sapiens
ttctagcatgtgattacttcactctggactgtgactttcagttggagatggaagtttttcagagaactgaactgtgtgaaaaatgacctttcctttaacttgaagctacttttaaaatttgagggtctgtgaccaaaagaagaggtatatcaagttgaagtcaagatgacagataaggtgagagtaatgcctatctccacagatggcttcactgaagaaaaggcattttaagattttgtaaaaatcttgtcagaaga

SEQ ID NO: 46513 - DNA, 271 bp, Homo sapiens
  misc_feature 239: n = A,T,C or G
aagtttgaaatatttctacaatgaaaacaccagaccatgtggtttttattggagtgataccaagctttttaaaacagatcatttcaatcctatacaaatgccttcagagatgagaaagaggaaatactctctcaactcatttgtgtgaggctaagagtagcctaaatcctaaaatcagacacgaagagagagaggagaatgaagccaaccctattcattacatagatgcaaagatctcntctaagatgtgtaaagtgagatgatggacatg

SEQ ID NO: 46514 - DNA, 179 bp, Homo sapiens
agccgccagttcatcttttttatatggggttgttgtctcattttggtctgttttggtcccctccctcgtgggcttgtgctcgggatcaaacctttctgggcctgttatgattctgaacatttgacttgaaccacaagtgaatctttcttctctgtgactcaaataaaagtatatatttt

SEQ ID NO: 46515 - DNA, 264 bp, Homo sapiens
  misc_feature 230: n = A,T,C or G
cattttcctctttctctccttgtacctgccagattatttaagaatttcagctgccaaattatacgaatgccatttatttacgtgacttgtgttggtctgttgattaatgtctaatgtttttctaatttcagactttaatttaccgaaaattctaatgaaaaaggctcttaagccagaaaccaattgtctcttatcgggtattcccaactggagatcttctatgagaaagntgggggagtgaaatgtaaaattttattcactaca

SEQ ID NO: 46516 - DNA, 176 bp, Homo sapiens
atattaagttgactttatcaaatacacaaagattttttttgcatatgtttccttcgtttaaaaccagtttcataattggttgtatatgtagacttggagttttatctttttacttgttgccatggaactgaaaccattagaggttttgtcttggcttggggtttttgttttcttgg

SEQ ID NO: 46517 - DNA, 137 bp, Homo sapiens
ggctccctcagtccaatgctctgccactaaagggaattaattttggttcttaacaaaacatctttttgtttttttctttacagatattgatgatgttaagaagttcaaaccgggttacctggaagctactcttaagt

SEQ ID NO: 46518 - DNA, 172 bp, Homo sapiens
gactgtattaatgtaaagacgtttattacaaaacttaatgaaatgcctaaagaaacaatataaagagatatagctaataagccaataaagaagataaaaaggaatcataaaaaacacttaattaaaaagaagtaaaaatgagcaaaaaggaacaaagaacagcttagaaaaa

SEQ ID NO: 46519 - DNA, 300 bp, Homo sapiens
ctatatgcactgagcctaggtaattgagagaagactctggctgaaaaagaaaaaaagggtatatatatattgggatatgggatatgcacatagatgtgtgtgtatgttatgtatacacatagatgtgagtatattgtatgtcacatagatgtgggtatattatatatacacatagatgggggggtatgtggaatatacacatagatgggggtatatattatgggcacacatagatggggggggatatatacgcacaaagagggggggggtattatatatcacatagatgtgggggatatt

SEQ ID NO: 46520 - DNA, 233 bp, Homo sapiens
ctcccaattaaaaatacatttttctgaaaacagcagtatcaacacaggaataattcagtgaatacagatgcctattgtgtgccaggcattctactaagatgcagcaattactgttttcacaatctggcagtaaaggtgaacatgaaaaaaaaattgtgccagccaggcacagtggctcacacgtaatcccagcactttgggaggccaaggcaggcagatcacctagggtcagg

SEQ ID NO: 46521 - DNA, 171 bp, Homo sapiens
gccaccacagctgctcctgctgctgctgcaggcccagctaaggttgaagccaaggaagagtcggaggagtcggacgaggatatgggatttggtctctttgactaatcaccaaaaagcaaccaacttagccagttttatttgcaaaacaaggaaataaaggcttacttctcc

SEQ ID NO: 46522 - DNA, 262 bp, Homo sapiens
ttgaaagtgccacctgatgaaagggattctcgagtccccatgctgaccttgaggaacttcgctttcactattcaggcaattggtaaagctcataaggaaacttgttttgaggtttcagtgagaattaactttgatcattcattcttaaattctttttttcactgatggcccagaataatttgacttgtatgaggactattagtatttcagtgtattagtgtggctcatgcatttggtctggtaattctcctatgttgatctc

SEQ ID NO: 46523 - DNA, 183 bp, Homo sapiens
aatttatagtgcttgatccattatcatgctttggtttgctaatttttcacataacttttctattcacaggctgttgtttttttacaaatttctcatattgggggttcggcaggtaaacacaaactggtattttcaggagggaaaagtgtttgttatggtattgaaccccattaaatttgttta

SEQ ID NO: 46524 - DNA, 132 bp, Homo sapiens
ttatgtccttcttatttaatttcttgggtgaggggggggataaaaaatttttcctttcttatttggacttttttttgaaaaaagggcgccgaaggaattccaaaaaaaaaaaattttccccccctacagggg

SEQ ID NO: 46525 - DNA, 206 bp, Homo sapiens
cttcaacatgagaaagctcctacagaagaagggaaaaaagaactgctgttcctaagtaacgcgaacccctcgctgctggagcggcacttttcctaccccctaaggcaagatcacagcatgtgaggaagacagtggacatcttcttttattctgggacccaaaaagatagagggaaggcgcggcagttacacacaggggagggggcc

SEQ ID NO: 46526 - DNA, 170 bp, Homo sapiens
tcttgaagctctgtttggtgctttggatccatttccatcggtccttacagccgctcgtcagactccagcagccaagatggtgaagcagatcgagagcaagacttcttttcaggaaggcttggacgctgcaggtgataaacttgtagtagttgacttctcagccacgtggg

SEQ ID NO: 46527 - DNA, 234 bp, Homo sapiens
aatttttgtgtttttagtagagacggagtttcaccatgttggccaggctggtctcgaacttctgacctcaggtgattcatccgccttggccttccaaagtgcttggattacaggcgggagccaccatgcctggccagaacaaatgcctttttaaaccttttaagaacatttttaaaatgtctttttctatgtcaaagtaacgcttatttttttaaacaataaaattgatttgcc

SEQ ID NO: 46528 - DNA, 132 bp, Homo sapiens
ccaaaggttcctaacaatttgcaaaaggaaatacctacaaacctacaaggtaaaggtcctaagggtctcaacttgattaccctttagcctttttccttaaacaaataacaaaaaaatttaaccacggatttt

SEQ ID NO: 46529 - DNA, 203 bp, Homo sapiens
tgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaggagttcgagatcagcctgggcaacatagtgataccctatctctt

SEQ ID NO: 46530 - DNA, 265 bp, Homo sapiens
aaagtatgataggttttttttgctatacaggacatctatattggtagagggtcatgtttaaattatacatatttttccgcctcatattgtcatttggtttgagcaggctgaataaacgagccccggaaagacataccccgtgcaggcatcagaactattttccacacgtattttttatagggatttatgtgtgggtcggggtgtcactcccatagtatacctcggggtctcaacaggggaggaggtgctactacgtctaggggga

SEQ ID NO: 46531 - DNA, 212 bp, Homo sapiens
accttacaataataacagcaaacgggttcttattatattattgagctgtattatcaaatgggtaataaataatccacaaagggggtctattagggaaatacttaaatacttcttccattactatttagagaaaatagagagagagaaaacacaggagagaacccccccaaaagggacacattaggacacaggggggggtcacaccccccgag

SEQ ID NO: 46532 - DNA, 221 bp, Homo sapiens
cacatgacttattatgcataaagccaaatttccagtttaagtaattgtctacaataaaaaggaattttgcccttccattttcaggatcaatctttgaaggtttctgttgatggtaacctagccactagaggtattctctaattcactaaatgggtaaaaatgtgggtgaaatatatatatgaatatataggaaagggctttctctttttaaattcccgaga

SEQ ID NO: 46533 - DNA, 242 bp, Homo sapiens
ttttggcctaggtaacggggcagagatgtggttcgagattctccccggactcttcgtcatggggcgtgtgcttgttgattccaggacttgctactgcgtacatccacagggtcacttacggggggcaaggaaaaaaggggtgctcaattttggtatcacttgagtgtctatatgaaagagatagagcgcatatctctgagattgatggcttactctatgtcaaaggggttttgagagcacat

SEQ ID NO: 46534 - DNA, 272 bp, Homo sapiens
  misc_feature 235: n = A,T,C or G
taattatcagtaacagatagattggggtgtttgctctgtgtgtgtgtgtgtgggtgtgtgtatatatgtgtgtgtttgtgtaaagggggagggtttcttctgtaaggagggtccataagcccatttgtcctgtaatacaagttaggtaatcacttatatagggggacacatatatatggggatctatgttttctgaaaaaaaagggggaaatgggagatatctcatatatttttntctctctctctgaaaaacactagggcgacgacgagga

SEQ ID NO: 46535 - DNA, 132 bp, Homo sapiens
tcctgtttagtctctcctgtaagccaaagaaatgaacattccaaggagttggaagtgaagtctatgatgtgaaacactttgcctcctttgtactgtgtcataaacaggtggataaactgaatttgtacccaa

SEQ ID NO: 46536 - DNA, 207 bp, Homo sapiens
cacctgattttgtatccccctgtagcagcattactgaaatacataggcttatatacaatgcttctttcctgtatattctcttgtctggctgcacccctttttcccggccccagattgatacggaatgaaagtgcactgcagttagggtcaaaggagagtcaacatatgtgattgttccataataaactctctgggggtgatactttc

SEQ ID NO: 46537 - DNA, 271 bp, Homo sapiens
  misc_feature 237: n = A,T,C or G
ttggctgcctgtggaggaagggagttcaggtaaagggtgagcagtagaaatattttagaggacattcaaagatttttaacttgtagttaaaccagatgatcctaaaatgctatttatattctgaggctccattaaatatttgagcacctactgtttccataacaatgtgagcatcacagcagacagattcagcagtgttgagaaaacgagatgactccccatgcttggagtattccnaatctcattgtggtggtggttaaataaaaattat

SEQ ID NO: 46538 - DNA, 206 bp, Homo sapiens
cagacgccattattccttgttctttcatcaccgaccctgacggttttccctgttttccactttgtcgcggccttatggcaacatcagcacctggggttctaaattttttggcccacccagaaacgccttaaatttttccttcaaggaaatatataatccgtaattggggtccccgttttaaaaagaatatgggaaccttaacaggc

SEQ ID NO: 46539 - DNA, 460 bp, Homo sapiens
ctcagaggttacttgatcagatctctggcgagttgcaagtctggtgatgagaatgatggagccctttaccacaacaattaagagaaaataggcttccagcaaacagttctttcacagggaggagatgttggtgggtattacttatgaccatgtcggaattaaatgtatactttaatggggaaaacatgcattgtccagcatcaggtatacgaggggcagtgtatccaagtgtgtatgtggatgacagtgcaattttggggttgccagttcagtaagtgttatcatacgcatccacctcgggtttgaaaaaatattatttgtacagcaaatcttctaaatgtatttgtttttaaactcgtatttctgcacttttaaaaaatggtcatcatttataaaactttaccggggcaatagggggaatatattcctaaaaaatgctcgttgatgctggctaaggggc

SEQ ID NO: 46540 - DNA, 394 bp, Homo sapiens
ttggtgatggtcatttattttgaaggatggagagattaaagactgcttcagggagacacacccgtgaggaggtgggaaggccacaaaaaggtccagggtcttggaggccgtttaggggagggcccgtctcaggtaaaattccaaaacccagaaaaaatttgttatacacacccctagggacattaccctgccctgagaaatgtgtgagccccacgttctctacaggctcttacacatcagcacagaggcgctctcatcatatattctgcacacatctatatatgggggctgcgcagagcacatgagggtagtgtgtagtcgcctctgtgtaaggggtgagaaatactacacctaccacctttatcatcataccataaagttctgctacttggca

SEQ ID NO: 46541 - DNA, 226 bp, Homo sapiens
tttttattttttcacaaggattttgtgaacctgaattatcatggacccatggtttggtaccccttttgtccacggttgttacccaccgggattagggggttttggtaattccctccaaaatgttaaggggggatgctccaaaaaggggcaattgccctttaaacccttaaaaataaccctctaagggagcccagggggcacattaaccccacatggggggtatata

SEQ ID NO: 46542 - DNA, 144 bp, Homo sapiens
tagaaggaagaggctcttttggtttagagcagagagctctgttggaaaaaggaaccagttccaggaaccagcccttaaaggaggcttaagagaggaacctacttaagaggagaggagccttctggaaaacttttaaatttaatt

SEQ ID NO: 46543 - DNA, 221 bp, Homo sapiens
taattgatgtccacccgagaaatccctgcagatgttcaggcctttgtcttggtccggtaggcaaaaaggaggggacctgggtttttggatagggaaatgttttctcactctaacctctcttaaaagagaggatgtgtggcccattgagccttccggtctctgcgaatgggattaaggaatgccctacatccccaccttcaacagcatgattcccggtcccc

SEQ ID NO: 46544 - DNA, 341 bp, Homo sapiens
aatacacttattatttcagcaatatttcctgagcaccacttatatgtctagggactggagatgttgcaattggacaaaaaggaaatgatccctacaaggaggggcaattaggaaggggaaatatatacatatattttggggggggggtaaggacccctgtggggggaaatagagcccagggactctggtcacaggagggtctctagagaggggggaaaggggtgtatttacacagtttaatataggggtctcaggggggctccccctgaagaggagacattcctctaggagattatgagcacagccacgacgatgatttttggggagaactacttctgcag

SEQ ID NO: 46545 - DNA, 143 bp, Homo sapiens
acggaaaccatgaagagcctattcttcttccattcttggccgcttaacggtaggaaccttgtgttatggattacaggaaagcattggatctttatggacctaatcccctcatataacaaagggggaatgggaaatatccctta

SEQ ID NO: 46546 - DNA, 167 bp, Homo sapiens
taaaagtggaggagtaggatgcaggagagagagcactcatgactttcaaggtgtcttatctgtgacaggatttttctgaggtacaactaggattggccctatacccttgctcttaagggacaaggatagggtaaatgcttctaggggcttaaggtgcagctactttt

SEQ ID NO: 46547 - DNA, 184 bp, Homo sapiens
ctacttaagctcaagtacactttgaacctaaacgagggattcataaggcagctttctttctaggaaaaaggcatggccacagactatttaaaagtctcattacagtataaactcaaggtagatgtaattttacacccattagtatttttcccattcttctcttcccacatagggcatcttttct

SEQ ID NO: 46548 - DNA, 205 bp, Homo sapiens
agatggtgtgtagtcacagagtgtagttagatccaactcccatgactctcgcttcagtggtaggtcgggcaggcagatgacagggcttcagtgggaacctctgagagcattttcctgttcccctatcaaccgcccccagtgataacatctgtgaggccagccattactcaataaactgcaaacttgtctaaaaaaaaaaaaaaaa

SEQ ID NO: 46549 - DNA, 171 bp, Homo sapiens
taaattagttcaagcataagatgaaacagaatattctgtggtgccagtgcacactacttcccacccatacacatccatgttcactgtgacagactgagtattcacagtacggcttctgagtagcactttctgattactcatgataaactgacatggctaacttcatgggtt

SEQ ID NO: 46550 - DNA, 288 bp, Homo sapiens
tttaagaattaacgaaagcagtgtcaagacagtaagggattcaagccattttgccaaaaatgagtctaagtgcatttactctcttcctggcattgattggtggtaccagtggccagtactctgattatgatttgcccctatcaatttatgggcaatcatcaccaaactgtgcaccagaatgtaactgccctgaaggtacccaagggccatgtactgtgatgagctgaaattgaaagggtaccaatggggcctccgggatcaaggatctttaccttgggataccagatt

SEQ ID NO: 46551 - DNA, 259 bp, Homo sapiens
tcaaagtaagttctagatggattaagattgaagcatgattaccagcctggggtaacatcgtgacaccatgtctctataaaaaatttaaaaaatagccaggtatgcacctttgggcccagtgcttttggtcccagctacttgggaggttgaaggtgggaggtgggaggatcacttgagacttggcagatcaaggctgcagcgaggtcatgatcatggccactgcactccagcctgggcaacacagcaagagccctgtccc

SEQ ID NO: 46552 - DNA, 131 bp, Homo sapiens
aagctttttattcctcctgctcatattgtgattctgcctttggggacttttcttaaaccttcagttatgatttgggttacatacacttattggaactctgcttgattttggcctatttccagttttcctga

SEQ ID NO: 46553 - DNA, 104 bp, Homo sapiens
atgatgacaaggttgatccacttcaagaattgcttgctttcaggaagagagatgtgtttcaacaagccaactaaaatatattgctgcaaatggcaaactaaaaa

SEQ ID NO: 46554 - DNA, 115 bp, Homo sapiens
gaagaagtaaaaacagaattgctgcacagcgctgtcgcaagagaaaacttgactgtatacagaatcttgaatcagaaattgagaagctgcaaagtgaaaaggagagctttttgaa

SEQ ID NO: 46555 - DNA, 408 bp, Homo sapiens
aagatatcatgatcacagtgattcccgaagaaattgacccataggcaggaggcatgaactggacttaatgtttccctcaaagactctcccgtggatgacggatgaggactctgggctgctggaataggacactcaagacttttgactgccattagatttgttcagtggagactccctcgccaacagaatcctccttgatagtttgcaggcaaaacaaatgtaatgttgcagatccgcaggcagaagctctgcccttctgtatcctatgtatgcagtgtgcttttacttgccagcttgggcattcttgcttagacagtcagcatttgtctcctcctttaactgagtcatcatcttagtccactaatgcagtcgrtacaatgcgtagatagaagagccccccgggggccm

SEQ ID NO: 46556 - DNA, 326 bp, Homo sapiens
gttggacttcacgggcaaggcaagtgggatgcctggaatgagctgaaagggacttgccaaggaagatgccatgaaagcttacatcaacaaagtagaagagctaaagaaaaaatacgggatatgagagacttgatttggttactgtgccatgtgtttatcctaaactgagacaatgccttgtttttgtctaataccgtggatggtgggaattcgggaaaataaccagttaaaccagctactcaaggctgctcaccatactgactttccttgagtagtgtttatctgaaatcaattaaaagtgtatttgttactttaaaaaaaaaaaa

SEQ ID NO: 46557 - DNA, 125 bp, Homo sapiens
tcgaatgtggaatgtttcaaagcctgacctcaacggcttgcccttgccgtaaccggaccgtaagtaatcttaaaaagttgtggcttgccaaaaaacccttcacggatgggaacaaagaatttggw

SEQ ID NO: 46558 - DNA, 211 bp, Homo sapiens
aataattatctcttcaagttgactcttacgtctttgtgatgtgatcctgttggactttgatggcttccttgcttttctggcaaaaaagtttgttccaggatcaatatactgttcccatacatggagtcagccattttctttaggaggccttgatttcttttagtagagaacgcagttttggatcttgagctgaatgacttttgtgaacctt

SEQ ID NO: 46559 - DNA, 142 bp, Homo sapiens
aagcctttattctgagagaagccacagagccctggaaagctggggatccacaggcagatgcagttgaggttaagatgaaaggaaactgagagagttttactgatgatgaagttgttattttttttgagggacttttttagac

SEQ ID NO: 46560 - DNA, 212 bp, Homo sapiens
tctgaaccaagatatatttatagttcacttttgggtttttatacccaccggtaggattctgcattccagcattaaatctgcttcattttagaacctttataaaagcaatagctggaatatactcccagttttaaaataaataaatgcccgattgatttaaagcaaggtagggtattcttgagggatatagggagggttttttatccgccaaa

SEQ ID NO: 46561 - DNA, 270 bp, Homo sapiens
caggcggacttgaggaaaccgcagataagtttttttctctttgaaagatagagattaatacaactacttaaaaaatatagtcaatagggtactaagatattgcttagcgttaagtttttaacgtaattttaatagcttaagattttaagagaaaatatgaagacttagaggagtagcatggaggagggaaaggataaagggtttctaaaacatgacgaaggtttgagatgaagcttctctcatgtgagtaaaaaatgtatttaagggagc

SEQ ID NO: 46562 - DNA, 136 bp, Homo sapiens
tctcccgcagtgaagtggacatgtggaaaattaggtctaattaaagagaaaagtacggcaaggccctttactatttatattcaagcaagaaaactaagggcggctaccaaaaagcgctgctgtacctcttgtgtgt

SEQ ID NO: 46563 - DNA, 153 bp, Homo sapiens
aaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtct

SEQ ID NO: 46564 - DNA, 146 bp, Homo sapiens
caaacagggatttttttaaaaggttttcatctttagaaaatacataatctgataaaagattggtatccaaaagaattctcaaactcagtaagaaaacaacccagtaattaaaaacatgggcaagaaatttgaacagagcattacac

SEQ ID NO: 46565 - DNA, 185 bp, Homo sapiens
aacacaaaacttatttaaagatgctttatatgtagaggttgtgtcaatcatactctaccccttaggtgagggcaaaggttaagttggtggaggaaattcctaaatacctttctaatgtccaatgttaataaaatcgtgtactaaattggaacgctagttttagagaaatatattacagagcgcct

SEQ ID NO: 46566 - DNA, 211 bp, Homo sapiens
acattcagactgagcgtgcctaccaaaagcagccgaccatctttcaaaacaagaagagggtccagcttggagaaacttgcaaggagaagcttccgcggtacttcaagaacatcggtcttggcttcaaggcaaccaaggaggctatttagggcacctacattaacaaggattgtccctttcactcgtgaatgtgtgcacacgagggcggaca

SEQ ID NO: 46567 - DNA, 151 bp, Homo sapiens
cccttgcaaaagcgcacctaacagacgccaaggtttgaagcaatcaggaaacaagggcaaggcagaccaccagaagccggacaccccagtttcaggtaaaaaaacgggaaagttcatatatagggagagggtgccacactccagttagatt

SEQ ID NO: 46568 - DNA, 205 bp, Homo sapiens
cattctaaaataataggagttaggaaataaataaagttttgctagccctgctaagttcaggcttagaggcttatcgctaagtgtaaacttcaccagattccacaaaaagctggatagctttttttctgacttatgttgttggtgcacccctcacaaattggcaggacagtattttaagcttgttacaacttgggtttgggtaccc

SEQ ID NO: 46569 - DNA, 150 bp, Homo sapiens
ccgattgtaactttttcaaagggaggtttacatgatttgtatcaacatcagatattttatatgtgaatatattaaacaaccttcaggggatcaatttcatgtatttaaggaaaaaggaaccttttttccggagtaaggtatttatggtgt

SEQ ID NO: 46570 - DNA, 319 bp, Homo sapiens
taatcatcaagtcagtagcctgaactgtcctcagacttccagtccaagctcttacctttatgggtattagaaggatgttgaagaattattccagaggtaggaggtattttaagaacctaccctattaggatcaatattagtcatagtattgggaagattacccctgcctgacatttacagagacatatatctcactctgactctcacactgtttttggggagttaaaaaaggttagggtattgttacctttacctcacagatgagacacagcacaggttcaggccaaatgcctccctacaaacagtatctcaggtctgg

SEQ ID NO: 46571 - DNA, 302 bp, Homo sapiens
ataatggaataggaccgcggttctattttgttggttttcggaactaggccatgattaagagggacggcccggggcattcgtatttcggcggtaggaggttaaattctttggaccgccgcaaggaggacccagaccgaaggattttccaaggattgtttccataatcaggaccgaagtcggaggttcgagagacgctcagataccgtcgtagtcccgcccatacacgatgccgcccggcgatgcggcggcgatatccctatgaccccccggcagctcccgggaaaccaaagtctttgggttcc

SEQ ID NO: 46572 - DNA, 303 bp, Homo sapiens
  misc_feature 270: n = A,T,C or G
cacagccctaaaggccaacccttttggaggtgcttctcatgcaaaaggaatcgtgctggaaaaaggaggagttgaagcaaacagccaaattcttccattaggaaggttttaagggtcccacttattaaggattggcaggaaattaacagccttttttcccaatgacggttcccttaactctatattagaggaaattgatgaggttctggtcccctggatatggtcacagagcacaccctgtgtgtgatatcccgggagcccgcttaaagnggtttcagagtggccattgtctctctttgcgcc

SEQ ID NO: 46573 - DNA, 323 bp, Homo sapiens
ttatacaggcttctgtattagaataatagcagtatttttggtaagattcgtgttgctattccctatttccccaatgtatctaaaatgaaatgttaaataagggataaaattacaaacccttgtcaattgggccctaacctttttttttatttacacatttacactgtatcgcgtgtgtacactcgatcacatagtgctctggtcactcacagacccctcacatttcatatgtcactaccttcttaaaattgggattacacatatctgttgtctcctcgcccttctataaagatctgatcaggctacaacacggtaggcttttc

SEQ ID NO: 46574 - DNA, 316 bp, Homo sapiens
tggcaagaacaagcgccttacgaaaggcggcaaaaagggagccaagaagaaagttgtttatccattttataaggaagatttgggattatgttaaagcaccttctattttcaattttaggaatatttggaaggcggttgttacccaggccccagggacccaaatttcaaatctaatggtctcagggcgcgtgtgttttagagtagagttcctctagttttcacagtgtgatgaggtcacatagagagtatacacgctgtatactagaggagttacgaggtaaactactttctttctgatctcacctgggcgcggtta

SEQ ID NO: 46575 - DNA, 201 bp, Homo sapiens
atggcaagaaaagctggcaacttctatgtacctgcagaacccaaattggcgtttgtcatcagaatcagaggtatcaattggggttaggccaaaggttcgaaaggggtttcaggttcttcggcctttggtaaaattttaaattggaacccttttgtaaggtttaaaaagggtttgattaaaattctttgggattttgagagc

SEQ ID NO: 46576 - DNA, 240 bp, Homo sapiens
actattgcacattttaagcttttatacctttatcttcttggaatggtcagattctgaactggacagtcagaaccacaggtctgctgttaagggattttaaattgtgcatttttaaccctacagtgaaattacttaaggtatccctgtgttcacagtgttgaggggctgtgtttatgtcacagtgtgggcctaaaaatgtgtttgtgataaagggggaaggggggttttcaaaagggtgtc

SEQ ID NO: 46577 - DNA, 120 bp, Homo sapiens
ctaagacataccaaaacacagacggggccaaaagaaattaaaataatggggacacttaatggacatttgggcaaaaaagcacggggccatacttggtttatatgggtttaaggggcaaca

SEQ ID NO: 46578 - DNA, 196 bp, Homo sapiens
tgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggggtatcaggatatttttgggatggtatctatttctctgaaa

SEQ ID NO: 46579 - DNA, 138 bp, Homo sapiens
ttcaacactctttatgataacaacactgtgttatattctttgaaatcctagcccatctgcagagcaatgactgtgctcaccagtaaaagataacctttctttctgaaatagtcaaatacgatattagaaaagccctcc

SEQ ID NO: 46580 - DNA, 209 bp, Homo sapiens
  misc_feature 184: n = A,T,C or G
tgacagagaagattcccgagagtaaatcatctttccaatccagaggaaacaagcatgtctctctgccaagatccatctaaactggagtgatgttagcagacccagcttagagttcttctttctttcttaagccctttgctctggaggaagttctccagcttcagctcaactcacagcttctccnaagcatcaccctgggagtttcctga

SEQ ID NO: 46581 - DNA, 222 bp, Homo sapiens
atccttttataagacagtttggagttattctctctcttctacctacaattagtttgaaaaattggagatttgatttgctgtgattgaaaatcctggattggctgaccaagacttggcacttttttccagccatttagttgaggttgaaggccaaaagccccttttgggtgactcactgagtacccatggttctgttctccctctggagatctcgcacgtatc

SEQ ID NO: 46582 - DNA, 125 bp, Homo sapiens
tttggtgcatggaattcattgtagaaagggaggcctggtttcatactttaggagaaataagggaatttcgacaccgaccagggtttttggcgccgatggacaataaaacagccaccggttgggag

SEQ ID NO: 46583 - DNA, 208 bp, Homo sapiens
atggaaatacacaggccctagaggtaagaaggagatgggtgtcttcccggaaactgataaaaagtcagagtggcttagatatgctgatatgtcccctggtattttttaaaatttttgggcgggtacagtcgctcatgcctgtacccccagcactttgggaggccgaggtgggcggatcacgaggtcaggagttcaagaccagccttac

SEQ ID NO: 46584 - DNA, 223 bp, Homo sapiens
cttctgctgagggggcaggcggagtttgaggaaaccgcagataagtttttttctctttgaaagatagagattaatacaactacttaaaacatatagtcaatagggtactaaggtattgcttagcgttaaggttttaacggaattttaataggttaaggttttaagagaaaatatgaagacttaggagagtagcataaggaaggaaaagataaaaaggtttctc

SEQ ID NO: 46585 - DNA, 589 bp, Homo sapiens
tgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttggtactgtgatattttaaatatccacagtactcactttttccaaatgatcctagtaattgcctagaaatatctttctcttacctgtatttatcaatttttccagatttttatcggaaaaatggattgaaacctagatgcagtgataaaggaattggataatatggtggtgatattttatctgatggccaagctactcggggaagcacggtttataaagatacttcc

SEQ ID NO: 46586 - DNA, 620 bp, Homo sapiens
ttcttgtgaaatttctgtactttgtatataaaatacataaaacattagattagaaatcaaaagatatctctggcctgcgatattttactgatgtgaacataggattttccactaaataatttgtctacttccagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatcaattctatacaatggataaatactccgcatataatttataaaaaataaccttctggttttaccctaagttaaccaattaaaaccctatggtggtgggggcccaaatggttattgccagaccaaaagggtctggctcaatccccataaccaagtg

SEQ ID NO: 46587 - DNA, 423 bp, Homo sapiens
ggctgctctaaccaatacagcatggtattggtacaaaaacagactcctggaccaatggaacagaatagatagctcataagtaaggttgtacacctacaccatctgattttcaacaaagctgacaaaaacaagcttttgaataggatgacctgtgcaataaatggtgctgagataattggatagccataaacagaagattgaaactggacccctttcttacaccaaatacaaaaatcaattcaagatgaattaaagacttacatgcaaaacccaaagtgataaaaatcctggaagacaacctaggcaataccattctggacataggaatgggcaaagatttcatggaaaaggcccaaaaaccattccaacaaaagcaacaattgacaaatgggatctaattaaacttaagaacttatgctcagc

SEQ ID NO: 46588 - DNA, 626 bp, Homo sapiens
gattcccgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggagggttgaagatgccgcatttggattggatgaattccaaatctgcttgcttgctttttaatattgaatatgcttatcacttacactttatgcccaaaatggaagggtataataatggtaaacatggacatgaacttctttataatccaccttggaggccggcccccatgttggaggatctgaacaggtggcccccagggagccctaggagggctggcacctaaa

SEQ ID NO: 46589 - DNA, 460 bp, Homo sapiens
  misc_feature 9: n = A,T,C or G
ttttagatnactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacat

SEQ ID NO: 46590 - DNA, 267 bp, Homo sapiens
aagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgat

SEQ ID NO: 46591 - DNA, 382 bp, Homo sapiens
atttcattgctgctaaaaatgacaaccccccccgtgccctgtttttcttaaagctgtcagtgtacaagtgggtatttgaataccaagaccttactgtaaaaaataaaaaaggtggtgtctacgagcatgtaaattggatataaagttctgctcttaaagagttgatctaagagtatggctaaacatcgatatatgcaatctattaaaagaacttaattcggctattatgtcttgatttgattgcagttttttcctaattataacaaatttttcctcattggctgtttttaaccctgtgcctagaaggagtacaaaatgcacactttacaaaattgatatttaacacttacccacgcccctttccccatctcttctaccgctc

SEQ ID NO: 46592 - DNA, 293 bp, Homo sapiens
agattggtattagttgattttgagttcttttcaacttataacactgctagtacagttatttctaaagcacagatgaaataggttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaaaaaaaaaaaaaaaaaaaaaaaa

SEQ ID NO: 46593 - DNA, 253 bp, Homo sapiens
tatattataaatgcagactagcactttacatttaaataattaaattatttaggtagatgcaatgaaaggaatgaaattttgtcatccacagatttcaaaaaggtggatgaaatgatttaatggtaagaacataacaccaacaattagaaatttcaaggttagaccgggtgcggtggctcacacctgtaatcccagcactttgggaggccgaggtgtgcggatcacgaggtcaggagattgagaccatcctggc

SEQ ID NO: 46594 - DNA, 241 bp, Homo sapiens
agggaaggaaaagcagagaaaaacagaggagctggaggaggagtctttcccagagagatccaaaaaggaagatcggggcaagagaagtgaaggtgggcacaggggctttgtgcctgagaagaatttccgagtgactgcttataaagcagtccaggagaaaagctcatcacctcccccaagaaagacctctgagagccgagacaagctgggagcgaaaaaaaaaaaaaaaaaaaaaaaaaaa

SEQ ID NO: 46595 - DNA, 294 bp, Homo sapiens
taaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcaattatttagtaaataatctcaataaattttgtgctgtggcctttgctaaaaaaaaaaaaaaaaaaaaaaaaaaaa

SEQ ID NO: 46596 - DNA, 537 bp, Homo sapiens
gactgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaa

SEQ ID NO: 46597 - DNA, 208 bp, Homo sapiens
gtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggcccccaaaaaaaaaaaaaaaaaaaaaaaaaaaa

SEQ ID NO: 46598 - DNA, 266 bp, Homo sapiens
cagagatgtggtcgagatctcccggactctccgtaatgggcgtgtgcttgttgattccaggactggctactgcgtacatccacaggttcactaacggggggcaaggaaaaaagggttcgctcattttggggtatcactggagtctaatggaaagagataggcgcatctctggagtagatcgttactatgtgtcacagggtttgggagacattgattaaggagcatttccctgattaatgaaaaacatactcagttatggccattta

SEQ ID NO: 46599 - DNA, 302 bp, Homo sapiens
  misc_feature 266: n = A,T,C or G
tctttgcgattcggcccgacggggcttcggtttcgctacagcatggtggccttactgaggaaaaggcttggacttcagttacatccgttaatcccagatctgtgacaaaagcagtgagagatgacactgaggcacagaattacacagcaaatgctgagaagactcctggcagcaacgtaaaaattgtgaaagtaaagaaggtatattctaccctgactaaagctagacatgctacatttccaaggtgaagatgtgtggacacatgnttatggcagattgaaagggatctcattccatgggav

SEQ ID NO: 46600 - DNA, 212 bp, Homo sapiens
taaatttctagtattttcacaagtttgtggatccatcactaatatctcttgaaaacccttcctccttaattcctcttggtctcccctcccaagagataagcccttcctggtgtaacctaggctggccttaaactcttgtggaaagggaaatctttccccctaaactccctaagtagctaagactaaggcacgttacttatccatagctatct

SEQ ID NO: 46601 - DNA, 245 bp, Homo sapiens
ggtcagtcttgttctatgaagggcattcaacctgattcggtgaggcatatccatgttaaggataggccctattgtggtttcccttaaaggccaattaattaaaaagtgtattttttatcccacaaaaacaattaagggaaacaattagagatatatgtgtttgccaaacaaattgggcacattatggcccagagcaaaatattttcacatatcagattatacacatgggggatggatagggcgcg

SEQ ID NO: 46602 - DNA, 227 bp, Homo sapiens
caagatgttaagggataattcaaaattttgtaaatgtgattaccactatctgttaaaaagttgaaacttgataaggctcgaagtaggaaagctaaatccctctcagggggggggcttttcttmataagggagggaaaaatttcccccccgtataggttttcacaagaacattttttcagcgataccaccctgcggttataatagcgtaaaacagagagacaccacct

SEQ ID NO: 46603 - DNA, 253 bp, Homo sapiens
tgaagtataaaaactcctgattttcagtctacgggtttatacagtgcaatggcttggggcattcttataggtgtgggaaattaggttattgggggttcccaatggcaatggcgtaaaggttttttttgagccccgggcaaaaaggaaatttataaaggattacttcccaccgtggcgccaaggtggacaacagtctcctaagcccacactggcttcatgagcttttatacccacgcctaatcccacccactct

SEQ ID NO: 46604 - DNA, 314 bp, Homo sapiens
  misc_feature 280: n = A,T,C or G
acaattctgattaagacgggttgacactagagattgacaggttatcaacgaaacttctcaagattaaggtgaacttggataaaaatttcaaaaacattaagtcacagcatatatattaccacacacggatttaaaaaagggggctcctatttttttaaaagaacacagttttacaaggtgccttctctaacagttttcccaggggcgcaagtatagtatttggctaaagatataagctttagtttcttcaccacccgtcactcctaaagcattttgcagncacagctcacacatatctgttttacaacagactc

SEQ ID NO: 46605 - DNA, 207 bp, Homo sapiens
gtcttctaaaaaaagactttaagggttaagcggttccttgccaagaaaaaaaagaaaaattcgtcccatttccaaggtgggtttcggataaaaaactcggaaataaaataccggtaaaacctacacaaagggagacctttggagaagaaaaccggtcggggatataagggtttaaaacccaaggttggaaaaaattttatggtcgtg

SEQ ID NO: 46606 - DNA, 210 bp, Homo sapiens
aacaaccctaatataacacacactacacatagggtatggccacacctaccttttaccaaccttagggtgaataaattgcctaatttaccccttgggaggtgggcctaccaccaattgttaaataaattattgttccaggcgacggcgtttcccaaggaattgaattgttgggttgttgatttttattttaggggagcggctcctaccccc

SEQ ID NO: 46607 - DNA, 172 bp, Homo sapiens
cttggcgttgcatgcctgtagtcccagctacttaggaggccgaggtgggagatcatctgagccttggaagtcgaagctgcagtgagccgtgattgcaccactgcactycagcctgggtgacagccgtgggaccctgtctcaaaaataaacacataaatatataaaaaattta

SEQ ID NO: 46608 - DNA, 300 bp, Homo sapiens
taaatattattatttccaggtagaatttttttcatgtagttttttaatatatacttgaaggaaatgtttcaccttatttttggtctttgtttattcatttagaccctgcaagttgattctcattaattgtcagattccactacactttcttcctcatagggagtaattaccagtgtaactaagcatttgtgttctgatatctgaggccagtaactattaatatctagttctcagagcatttggagagggtatcttaaatggctacctcaaattgagatcctcttcagagaaaatataatt

SEQ ID NO: 46609 - DNA, 224 bp, Homo sapiens
gtgagattgttaaaagggtgcaagactgttgcctctctttttttgagatattcccctatctctcactttctcaggggatgaaaattcgttttcaaaggttttgaaagttcccttggcaaactttagaccatgtatgtggagtggggtatcccccagataaaatttaagagggagtttttaaaaagtaattactgtcacataaacttgatatataggggatttgt

SEQ ID NO: 46610 - DNA, 285 bp, Homo sapiens
atttaaaataaaaaagcgtaaggtagaaatactggcacttggattaatgaagggcaacttttacttttatgaggtttgttatatttccctattgccccctctgttgatgtatgcacccatgtccatccttaataccgtgggcaaaaatcggggagttagcatcttttgtgttctgagagcgccactcacttctcaccatccagttattattggtgggatggagaagtggccctagaccttctagtcactctagcatgggccctctcaccacatcctcttatactg

SEQ ID NO: 46611 - DNA, 149 bp, Homo sapiens
ttaattcatgatgtttgcccttttaataaaatataagggtagagttcattttgaatgcaagttgcctttattataaatttggggttgtcttgggtataccctgcatgataacccagctagatttctagcatttgctgtatttattaaaa

SEQ ID NO: 46612 - DNA, 209 bp, Homo sapiens
tccaaaggaaaaagaggttaggttttttccagacttatgatacagatatttggggggtggttttgttatctgtcccgggtcaaaaggggagttcaccaaggccacagtgtttcatttttggggggggtcttttcccgtgggaacctgaaagcccgcgggttttttctcttcttttggggcacaccattcggggtttggggggcccaccg

SEQ ID NO: 46613 - DNA, 290 bp, Homo sapiens
tcttatattccgacggatatatctggcaaacgaatacatatttgactttgagttataatatgggtttgtgacttatgagctgtgactcaactgcttcattaaacattctgcattggggataatctaaggattgtttacaaaaaggttattttgtatttacccctcattcccttttttgatccctgtaaggttagtataaatatatctagacatttcagactgtgtctagcagatacgcgccccttaaaggggctagaaggaaaagttctcggtctcactattttgatctg

SEQ ID NO: 46614 - DNA, 289 bp, Homo sapiens
tacctattgtagatattgcaccctatgacattggtggttctgatcaagaatttggtgtggacgttggccctgtttgcttttttataaaccaaactctatctgaaatcccaacaaaaaaaatttaactccatatgtgttccccttgttctaatcttgtcaaccagtgcaagtgacccacaaaattccagttatttattttcaaaatgtttggaaacagtttaatttgacaagaaaatgatatttctcttttttgttgttccaccaataaaaatttagatggttttggttt

SEQ ID NO: 46615 - DNA, 117 bp, Homo sapiens
  misc_feature 115: n = A,T,C or G
actcttaattaatatctgtatcctggaacaatattttatggttatgtttttctgtgtgtcagttttcatagtatccatatttgctgactggtttattgacttcccatggactttntg

SEQ ID NO: 46616 - DNA, 154 bp, Homo sapiens
attgccggcgtcttggcgattcggcccgacgagccccgctttcgctacagcatggtggcctacttgagacaggcttgactcagctacatccgatactcccagatctgtgcaaacgcagtgggggatgccctgaggacagatttcaaggcaattc

SEQ ID NO: 46617 - DNA, 108 bp, Homo sapiens
ttggtcggtgggtttctttagatttacttaaaaaggtaagtaaaagaatttgagttgttgatacaagatactgcgaagtgtaacttcaaacagtatagctttcaactt

SEQ ID NO: 46618 - DNA, 286 bp, Homo sapiens
gcatcctctgccaagaccaaaaggaaagaagaaaaagggccaaaagccaaaatggaaactgatggtacttgttttcagcattgggctaactttgctgctaggagttcaagccatgcctgcaaatcgcctctcttgctacagaaggatactaacggatcacagctgttcacagccttccggagggggtagctgacctgacacagatttgatgtcagtgtccaggatcatttctgggatgggaggggatgtgagatgatctgttactgcacctccagcgaattgctct

SEQ ID NO: 46619 - DNA, 211 bp, Homo sapiens
aaataaatgtatgtttgttgttgttgttgttgttgtttgagacagagtctcactctgtcacccaggctgcagtgcaatggtgtgggtctcagctcactgcaacctctgcctcccaggagaattgcttgactcccagaggcggaggttgcagtgagtggagacagcaccaatgcactccagtctaagtgacagagcaagactctgtcccaaa

SEQ ID NO: 46620 - DNA, 382 bp, Homo sapiens
acttgtatataccttcattcatccttaagttcaagtgcaaggaatgcccgagaaattcccacatctggatagttttctgagtttttcttcatcgcagagtaactatgctgatacagataacacagccttactatgatgcagatgggtttaaaagtttctatatcctttaagagggaaaagagttcttatcactcttacctttcctgtgctacagagaacccagatccagacctagaaatcaggagctgatgttgcctacagattacagagaagtgcacaagtgagcatgtattcctgtcgtaggagtatttcatctgtgcagagtgccagtgcctccttttacttctcatgggccctagagaatggacagattgggtataat

SEQ ID NO: 46621 - DNA, 388 bp, Homo sapiens
ttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccacacaacttttatttctcagagtcttccttaatcctatggaacaagaagctgccactgaatagggcccagtataggggcttgcttttctactccctcccccca

SEQ ID NO: 46622 - DNA, 351 bp, Homo sapiens
  misc_feature 89: n = A,T,C or G
aacttcagtttaaaattaatacttttatttgactcttaaagggaaactgaaaggctatgaagctgaatttttttaatgaaatatttttnacagttgggcagggtaaataacatctgacagctaatggggatattttttccatacaagataaaaaggatttaatcaaaaatttcatatttgggcatgaggtcccaaatctaggttcaagttcaatagcttagccacataatacggttgtgcgagcagagaatctacctttccacttctaagcctgtttcttcctccataaaatggggataatactctacaaggttgttgtgaggcttagatgagatagagaattattccata

SEQ ID NO: 46623 - DNA, 240 bp, Homo sapiens
ctgctctgctgcccgtggctgtgcaagtgtgcccacggctgtgtctgcaaagggacgttggagaactgcagctgctgtgcctgatgtgggaacagctcttctcccagatgttaatagaacaagctgcacaacctggattttttttcaatacgatactgagccatttgctgcatttctttttatgttaaatatgtgagtgacaataaaacaattttgacttgcgaaaaaaaaaaaaaaaaa

SEQ ID NO: 46624 - DNA, 319 bp, Homo sapiens
ggtggggaacatgtctgagtcggagctcggcaggaagtgggaccggtgtctggcggatgcggtcgtgaagataggtactggttttggattaggaattgttttctcacttaccttctttaaatgaagaactgtgggccattagccttcggttctggcatgggattacggatggcttcttcccactgtcagcgtgatttacaggctccatatcttctacagagaaaatatgtcaaagagcaggagcagtccttcacctgagsacatccagcgggaggacaagagatatcatgtttattctcaggatactgaggtgccctgg

SEQ ID NO: 46625 - DNA, 311 bp, Homo sapiens
acgtcatcgtttggaaagcgtcgcaataagacgcacacgttgtgccgccgctgtcgctctaaggctaccaccttcagaagtcgacctgtggcaaatgtggctaccctgcccaggcgcaagagaaagtataactggagtgccaaggctaaaagacgaattaccaccggacctggtcgaatgaggcacctaaaatttgtataccgcagatccaggcatggatcccgtgaaggcacaacacctaaccccaggaggccagctgttccagcatccagttcatcttgaggagtcgtcacggttgagtcatgctataa

SEQ ID NO: 46626 - DNA, 266 bp, Homo sapiens
atcatttcatactatcatatatgttcaatgtctatacaggaggacatatttcctatgttccttgtggttgatgagacatttcatccaagtatgccttcattttctgccaaggattttgaattatctaacctttttggtccaggccttgggcacacagttgaaaatgggcaagggaattcccaaaagaatttccccacaaaataaagagggggggagagcacagggtggaagctctgtgcacagagtagagaagagacacactattg

SEQ ID NO: 46627 - DNA, 199 bp, Homo sapiens
cttgccagctgccaagatggagaagcatgtgcccctgtagagcgtctccccagaaccagaccccgagccactcgcttcctctgtgctgtgacaacattggtgccaggggagattgtgtttttcaaagggaccctctgtagccactttaatttacaattaagagccttagtgtgactttacactcttgtagggtcttcaa

SEQ ID NO: 46628 - DNA, 242 bp, Homo sapiens
tcgccggaggtggtgggagttagttttggcagcccgggcctgagagaggtcaagggtcattgcagagccagggaggagatggtgaaggcagactatccagatattcgcgagggtgtaaggcccctgttccgaagcacccaacaaagggatttatttcatagagtgaagatgaaaaattaatatctcgctctgagatcatatccccacgcgatatcgcacagaggggtgtgtatatatgcgcg

SEQ ID NO: 46629 - DNA, 171 bp, Homo sapiens
tcatggatcaggtaatgcagtttgttgagccagtcggcagtttgtaaaggactccattcggctggttaaaagatgcactaaacctgatagaaaggattccaggaggttgccattgccaaccgcaattgggtttgctattttggggttccttgcttctctgtgggattggtc

SEQ ID NO: 46630 - DNA, 150 bp, Homo sapiens
ttacctgatttaaaaatctctgaaaaccgggaaggggttccaaaaatctgtataccgcgattttaatgtcccgttttttatgggtttgagtaggcgtgagtttgtggggttatatcccagcccctctacccctctggggattttgggggg

SEQ ID NO: 46631 - DNA, 311 bp, Homo sapiens
gtttatgtttagttttggtagaggtgttatgtataatgctttgttaaagaaccccccttttccgtgcccacttggtgaataggggatttgattgaattggggaggagttgagtcagaccagtaaggccgttccttgggttcctgaacaaggtcccatgtttgggggttaaaacccattctgggagtgtctctgtaactttccaaaataaactcttaatttttgtgtataggggaggctctgggtcttctctgccccggggcgctttaaatcctcatcgtgccatcctctgtcatcggcccccacagacaca

SEQ ID NO: 46632 - DNA, 211 bp, Homo sapiens
tcaaatacaagattgattgctgctgctacttctgtattaaaactagatttcatatgcctttccaaagggatttccttatagggtggaatcatatatgagggggggaatctatcttgtaggaccaattggattgttgccttgtaggggataaaaaccattaggcctctcctccggaaagcaggcaagggccaggagacacatgtggttcccc

SEQ ID NO: 46633 - DNA, 244 bp, Homo sapiens
gctccttctgttccttcacttaataatatcacgaacattttcggcatatcaaactttctcaacagcatcttcattgtatggatggacccctttgttatcaccaatcctcaaatgagggattatttccattgttccccatcttcaaaagtaaataggtgttgcccactgacacacttggagcaaaaatttgcacatgtctttagggcgtttcccagggtaaactccccgaggggcctcgcttctg

SEQ ID NO: 46634 - DNA, 448 bp, Homo sapiens
atgaacagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctgggaggctggcacctgattttgtatccccctgtagcagcattactgaaatacataggcttatatacaatgcttctttcctgtatattctcttgtctggctgca

SEQ ID NO: 46635 - DNA, 517 bp, Homo sapiens
gactttcaagaattgtgaaagatcggagattctaccctacttgcaagctaacaagttaatctgccacaaattcatattgttataagacgtgagactcttaggtcacagatggaggacaggttattacgtatatcaatagcagtcaccagagtctccgtatttttgtgttagttcacgaacttattctgttcaggctgcagtaacaaaattgcataaagcaagttgcttctaaacaacagaaatttatcctcactgttctggaaggtagcaagttcaagatcagatggcatcaagttcaagatttgatgtctgctgaagacttgtttcgtgattcatagatggcaccctctcactttccttagacggtgcaagggccaggcaagctccctgtggtctcttttataaggctacgaaagtcgtttatgaaagcagagcttcgtgatctctcacctctgaaaagccccacctcttaatgccattgcctcgggatgttaggatttcaacataagaattttgg

SEQ ID NO: 46636 - DNA, 256 bp, Homo sapiens
agagggagagaggagtacgaaggcccaaacaaaaaaccccgattttagatgtgacatttaggctttcattccagtttgttttgtttttttgtttagataccaatcttttacactcttgcattttagtaagaaagctatctttttatggatgttagcagtttattgacctaatatttgtaaatggtctgtttgggcaggtaaaattatgtaatgcagtgtttggaacaggagaatttttttttcctttttagttctt

SEQ ID NO: 46637 - DNA, 404 bp, Homo sapiens
atgagtgaacctcttttcccttttgttttctgattttctgcgaaacttctgttcacatagcaatcctggttttgtgccccatcttctccttgccccatgaaagagaatggagttatctgattggcagatgccatccgtggtccgtatttctcaactgagtagaaactgactcactaaaaggcagcaagccccagatcaataagaggcagaaatcttattctctagtgatactgcaggatcctctaatgagatcctgtaggcaagctggcccaaggtctagacttagacttcattaacatatctaaagtcatgttatccaatcggctttattagtactaaagctgacatttctatctttatctaggtctgatttctcaaatgtatctgaacatgagaggagaggg

SEQ ID NO: 46638 - DNA, 330 bp, Homo sapiens
gtgctcgcatgctgataacaattctgggcacggtgaagcccaatgcaaacagaattgctttagatttcaaagagggatgatgttgccttccactttaacccacggttcaatgagaccaacaggggagtcattgtttgcaatacaaagctggataatacctggggaagggaagaaagccagtcggttttcccatttgaaagtgggaacccattcaaattacaagtactggttgaacctgaccacttcaaggttgcagggaatgatgctcacttgttgcaggacaatcatcgggttaaaaactcaattgaatcagcaacttgggatttcctg

SEQ ID NO: 46639 - DNA, 280 bp, Homo sapiens
cgagtggagagagcgagctgagtggttgtgtggtcgcgtctcggaaaccggtagcgctgbcagcatggctgaccactgactgagagcagattgcagaattcaaagaggctttttcactatttgacaaagatggggatggaaccttaacaaccaagggattgggaactctaaatgagatctcttgggcagaatcccacagaagcagaggttacaggacatgattaatgtaggtgatgctcatggtaatggcacaattgaccttcccgaatttctgacactt

SEQ ID NO: 46640 - DNA, 175 bp, Homo sapiens
atgattcatgtattatatagatttgattatcctattccacgtctctttttttgtaaatttatgtacagattgattttcatagttttaactagatttccaagatattttgtgcatttgtttcaactgaattttgggggtgttagtgcccttatctggcaccctgatttttcgccgg

SEQ ID NO: 46641 - DNA, 250 bp, Homo sapiens
tgcacacacatagaactccaacatcaatttcattgcacagactgactgtagttaattttgtcacagaatctatggactgaatctaatgcttccaaaaatgttgtttgtttgcaaatatcaaaccattgttatgcaagggattattaattccaacatggaggatttataccattgtggtttaagctgtactgacttaatctgtggatgcattgtgactgtaaagccaaggtgtcatgaggcttttgggctt

SEQ ID NO: 46642 - DNA, 330 bp, Homo sapiens
ggctttaaagtgctcaggggtccctgaaactaattttctatttctgggattccctggattcattatatgagatggtgacatgattaggggaattcttttttagtatgaaaattgtcccttttcttcttcagtacttgcctccttgctggcattgaattaacacagggccaaatttggttaatttttgatttctaactctcccacaaacccctgttgcccagtatttgtttgggggcctctcaccacctggggggagaagatgggctttttcagctgccatctttatctctgggcttgggggccctgtattgtccggtgcccagggttgtg

SEQ ID NO: 46643 - DNA, 285 bp, Homo sapiens
cagtgtttactgtagtgtatcttgtacagatagcatgtatttttaaaggaaaaaaaaaccggaatttgaagctattttttcttgcatttctaattgacctgagggaccattccgctttgaaatgtactgagagtacagtttctgggtttttcctccccaatttgcctaataatgcttgagagtgtctaactattaaaaaaggccaattgagaaatgttatgcatggggtgtttcaggaaacaaagagttccccttatttgactgccacatcattttcactctata

SEQ ID NO: 46644 - DNA, 280 bp, Homo sapiens
taattccctcctaaaaccaaaaaggagggaaacgtcaactccattgcaattacttatcttcctcttctatctctgttatacgccggggcatagaatgctcgtatacatctctttacaaccacaaaccttaggccatgtaggtgaagttagtgcatcaacgcggttacagttccatattgccttaaacctccttgttttaggcacactaacatttataccagattgcagattattctgcagagagggaattgcatgtctgtgttgtatatgtagtatgagc

SEQ ID NO: 46645 - DNA, 209 bp, Homo sapiens
ttctcaacaaaatacttgttgacttgatgttttatcacttctctaagtaaggttgaaatatccttattgtagctactgtttttaatgtaaaggttaaacttgaaaaggaattcttaatcacggtgccaaaattcattttctaacaccatgtgttagaaaattataaaaaataaaatacttttcgggcggtttaaaaaaaaaaaaaaaaa

SEQ ID NO: 46646 - DNA, 145 bp, Homo sapiens
agatgttttgtggaccactttggttttctttttgcgtgtggcattttaagttattagtttttaaaatcagtactttttaatggaaacaacttgaccaaaaatttgtcacagaattttgagacccattaaaaaagttaattgtggg

SEQ ID NO: 46647 - DNA, 138 bp, Homo sapiens
ctagtagaggaatatgtcgagtttctctagggcgcccagcaattggccacttttgctaggaatatggtatctcttagaatgggaaaatgtcagaccacctggcaaaactttctccctatggaatctataagaacttca

SEQ ID NO: 46648 - DNA, 237 bp, Homo sapiens
agctgtgctcgcgctactctctctttctggccttgaggctatccagcgtactccaaagattcaggtttacttacggcatccagcagagatttgggaagtcaaattttcctgtaatttctatgtgtctctgggttcataccttttccccacattaaggtggcttttctctagaggtgtgggagagagttttgaaaagtgtgggcgcattacagtcttgtcttttcagcaagggtctgg

SEQ ID NO: 46649 - DNA, 307 bp, Homo sapiens
  misc_feature 269: n = A,T,C or G
atcaaggacagtaactaccatggcttccgaagttttgccaaaacctcggattcgttggcttcttgccaagcgtcttcgaaatcatatttgctttagcattcgtgctatccccctggggttgcacacttttttatataggtttgcgtgtgccctttcaaagagagagagggaaatcccgcagtttttccacagaactctccgttgtcatgagagtttttggggagatgaggagggctggtttctcccagagtgtaaagtaatctgggtantatagagagtttctccaggttgaattacctggaagttt

SEQ ID NO: 46650 - DNA, 113 bp, Homo sapiens
ataaactctagggagattgaatttcgctcttatcaatatttgcttttaaacaatttattgacttaaaattttaaaatgccttaattatggtatggtaccttctctgtgtgtgt

SEQ ID NO: 46651 - DNA, 221 bp, Homo sapiens
aaagccaaatgaacttatggtactgttcacattggctactttctctaggagtcaagccatgcctccaattgcctttttgctaaagaggttcttaaggtcaaactctcaacctcccggagggggtggctgccctcacagagattggtgtcattgcccaggctcatctctggctgggagggatgtgtgttgctctctcactgcacctacagcgattctctctc

SEQ ID NO: 46652 - DNA, 174 bp, Homo sapiens
ctcaagctcttcgataccaaaatcaaggagcatcttggattattaaattatgtaaggaggtagcacacagttttcgggtaataatgtgtgtaaaaagtccctgctttacacttgtgaaggtgaatctcattgaatgacacacacccacgttcccatttaggggctggagtgtgc

SEQ ID NO: 46653 - DNA, 206 bp, Homo sapiens
tttccctaagcagataagcagaaacttgtttaactcattactttgtttgatgtgtcttacatatttttgactaaaaggtataggatgttattcccctgggggaatctttttacaaagtgggggggattgggataccacaaatttccccaaaagataaaaattggcatcaccataacccgtttgggcaaagggggggtttaaaggca

SEQ ID NO: 46654 - DNA, 114 bp, Homo sapiens
aatctgccattcctaaaaattttataaacacttgatacttttcactgataatggatcgctccaataaacatatattgtgaaaatgcatccacaataaatgggattccctcccgc

SEQ ID NO: 46655 - DNA, 195 bp, Homo sapiens
ttcttattcgggtgtgagtcttttcagcaacccggtccagtactgggagatacagccatccaccttcagatgtgtctacgtgcgctctgccattcaactcgggaaactataagtaattctcaagcaagccctcatttttatagcctggcaaaatctttttaatgtcattgctaaaaaataaataacaggctagtt

SEQ ID NO: 46656 - DNA, 231 bp, Homo sapiens
agcattctgggttcttgattttagtactccgaagaatatggtggtctcatggagtagctgaccactaaggaggggaggattaaaagggaatcacttatcagtttttagcataggatgcattaagcaatatcaacggataactgacatcgttttgttaagaagttaactgttatcatagctcactacttccagagcggcaatggatgttcagcgagaagggatgaaaataca

SEQ ID NO: 46657 - DNA, 195 bp, Homo sapiens
attatggttccgttctgaaattgacatgaatgatatcaaagcattctatcagaagatgtatggtatctcctttgccagcatcctggatgaaaccaaaggagattatgagaaaatcctgggtggctctttgttggaggaaactaaacattcccttgatggtctcaagctatgatcatgaggactttaattatatat

SEQ ID NO: 46658 - DNA, 268 bp, Homo sapiens
  misc_feature 31: n = A,T,C or G
ttatatctataccaacaactttttgttgctntggataccacagattgtcctgaattaaaaccctaacataatagatgtctgtttagccgttactttactgagtaataatactatattgtggcagtatggccctttaatactaaggaggtatggtgtagaaattatttgaccactcatatccaaatgttattaatgatgtttgccagatttctcaatgcttaatgatattccccactcctcattccagggtggaggggggtttggtccc

SEQ ID NO: 46659 - DNA, 360 bp, Homo sapiens
tgcttataaaggacaacagcaatttgagagaacaccatctctctaggtcattcctgtaggtcatctctctaggtctactttcaaaggtacgtaaggaatgaatttttatattacctacccccccattttgatctcataaagctttttgtcgaattatacatctatacatccatacatcctaattactgtacgaatatgtttacatctttgtgcttgactttgaataattctgtgagagtttccagttacggatattaccatgtatggtcatctcctcgtaactcagcttaatttgagtacctctgagctagccagataacttgcaaatctgttgatttataagatgagtatttggtggcc

SEQ ID NO: 46660 - DNA, 260 bp, Homo sapiens
aacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaggtggactttggcagacaccattatattgttctatgagttctaggcatttaaatggtaccatcaaggcaaggtatacatatgggagccagtgaaagggga

SEQ ID NO: 46661 - DNA, 250 bp, Homo sapiens
cagcagctgtactgagcaccactaaaattcggcagggttctcgctcttgtcgtgtcttttcaacggcacgtctgatccggaaatatggcctcaatatgtgccgccagtgttttccgtcagtacgcggaggatatcggtttcattaagtgggctaaatgctcttccttcagagggttatccggggcatctactcaatgaaaaaccatgataattctttgtatataaaataaacattcgagaaaaaaaaaaa

SEQ ID NO: 46662 - DNA, 240 bp, Homo sapiens
agccagcgcaggggcttctgctgagggggcaggcggagttgaggaaaccccagataagtttttttctctttgaaagatagagattaatacaactacttaaaaaatatagtcaataggttactaagatattgcttagcggttaagtttttaacgtaattttaatagcttaagattttcagagaaaatatgaaggcttagaagagtagcatgaggaaggaaagataaaagggttctaaacca

SEQ ID NO: 46663 - DNA, 255 bp, Homo sapiens
ttgatctagccatctgcagagcaatactgtgctcaccagtaaaggtaaccttctttctgaatagtcaatacgaattagaaaagccctccctattttcgactacctcaactggtcagaaacacaggttgtattctatgagttccagaagatgaaaaaaattttatacgcttgataaaacttataaatgtcattgattaatctccctgaagagtggtttaaaagagaagtgtaatgcagagtttaaagagatatttt

SEQ ID NO: 46664 - DNA, 181 bp, Homo sapiens
ccatgtacattttctgtaataccaaacgctactgattcccatgccaaaatacatgagtattatgggattgctacctgtataaacaatggcactgtgagaatactgttaggtttcaggtacaaggaggacatggcatttggtagaattaatgggtattaggaggtttatttaattattacct

SEQ ID NO: 46665 - DNA, 301 bp, Homo sapiens
agacgttgaaagcctacagctcactgtttttggtgctctggaaatgttgagggtgggttttccaccagtgattttcaacgtgcagtgaatttgttagacttttaaacaccagctaaggtagtcaaccttgatccccattaaccttcagggatttaggggtcgggggagggtttaggagtgatccagagtgacctcccagaattactgtgcgtacacctttatttttgagagttttcattggactggtaagagttttatgacagacagttttaagacttatgctgagttaaatattaatact

SEQ ID NO: 46666 - DNA, 319 bp, Homo sapiens
agggttaaaaaaataatagaactgaaaaggaaagtctgtggcgattcagataaaggatttgttgttattaatcaaaagggaattgaccccttttccttagatgctctttcaaaagacggcatagtcgctctgcgcagagctaaagggggaaatctggagaggctgactcttgcttgtggtggggtagccctgaattcttttgacgacctaagtcctgactgcttgggacatgcaggacttgtatatgagtatacattgggagaggagacgtttaccttttattgagacatgtaacacccctcgttctgtcacattattg

SEQ ID NO: 46667 - DNA, 304 bp, Homo sapiens
gtgatggcagtcatcatgcttattgcagttagcacacacttttgctgacaggcacagtgctgctgtgctctacaaatgaccatgagatagagcacggcatgactttaggacacagggatttttattggaagagaggttcatcagggacttattacgtaggagagaacgattcaggggaaattgttgccaccctctctcacttgaatagcaatagctgctgtttagcaaagactctattaaaaagtactctgatttttccagataggagagagaacacattatatcagagtagagagttttattc

SEQ ID NO: 46668 - DNA, 148 bp, Homo sapiens
  misc_feature 32: n = A,T,C or G
gctccaacataaaggaatattccttcatgttntctgcctggagaactcctctaatctttcttgagacatactataccatctttattattgtggccggtagttatgatggcctttggcctgcctggttattccatccaaaaaatatttc

SEQ ID NO: 46669 - DNA, 190 bp, Homo sapiens
  misc_feature 33, 73: n = A,T,C or G
ggttacattcgttgaaggacaccagctgcggantttgcggctttggcagattgaaatcatggcaggtccaganagtgatgcgcaatacagttcacttgtattaaaaaatatttcaactctttatactctcacaggtaggaatgaactgtgtactggccacatattggagcattgcattgattgtcttata

SEQ ID NO: 46670 - DNA, 306 bp, Homo sapiens
  misc_feature 31: n = A,T,C or G
tcacagctatatcctgatgctggatggtatnaatcttgtgtagtcttcaacctggttagtgtgaaatagttctgccagctctgacggaccactgccaatgctgtacggactgcatttgccccttgagccaggtggatgtttaccctgtgttatataacttcctggctccttcactgaacatgcctagtccaacattttttcccagtgagtcacatacctttgggtccagtgtataaatccgatatcatgtcttgtgcataaagtctaccacaagggtcttatttttgtgagctctatcagtagtgt

SEQ ID NO: 46671 - DNA, 291 bp, Homo sapiens
aggcagccagcgcaggggcttctgctgagggggcaggcggacttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattt

SEQ ID NO: 46672 - DNA, 282 bp, Homo sapiens
aggcagccagcgcaggggcttctgctgagggggcaggcggagttgaggaaaccgcagataagtttttttctctttgaaagatagagattaatacaactacttaaaatatatagtcaacaggttactaagatattgcttagcgttaagtttttaacgtaattttcatagcttaagattttgagagaaaatatgaagacttagaagagtagcatgaggaaggaaaagataaaaggtttctaaaacatgacggaggttgagatgaagcttcttcatggagtaaaa

SEQ ID NO: 46673 - DNA, 134 bp, Homo sapiens
acaaattggacctgataccgtatggtgggaccaaaggtaccttgttgacatcaaatctaaagtttttgctttgggaaaaaaagatgggggatggatctgaggcaaagcgattttcaaaacacaaagagggataa

SEQ ID NO: 46674 - DNA, 135 bp, Homo sapiens
tcattagtcccgatggttctcgtaaaaacccgctagaaactgcagagacctgaaattctgccatcctgaactcaagagtggagaatacttggttgaccctaaccaaggatgcaaattggatgctatcaaggaatt

SEQ ID NO: 46675 - DNA, 117 bp, Homo sapiens
atgtgtggtgaatgtaaaatacctagtttacttgccagtctcttgtgtaaattacagataaaacaaagtgaaatgtatatttttaaaacaaaaatattaaattttgttttcacaaaa

SEQ ID NO: 46676 - DNA, 114 bp, Homo sapiens
gtggtcgcgcacactttaatcccgctactcaaggagctgaggcaaaattccctaaccccgggagggaaaagttgccatttagatcaagccccgttttttccccccccccctggg

SEQ ID NO: 46677 - DNA, 158 bp, Homo sapiens
taatgatgttgacttgttgctgagggacagcagttcacttacactgttcttgtaggatgggtgctctaaaaaggacaaatgaatgggggaagaacaatcattgggatacaaaacaaataaggcatcacgcgctttccctttccttgtatattttcacc

SEQ ID NO: 46678 - DNA, 129 bp, Homo sapiens
atgtacaggctgacagagaagattcccgagagtaaatcatctttccaatccagagggaacaagcatgtctctcttccaagatccactctaaactggaggtgaatgttagcagaccccccccttagaggt

SEQ ID NO: 46679 - DNA, 149 bp, Homo sapiens
tttaaagacgcatgttatggtgctaatgtactttcacttttaaactctagatcagaattgttgacttgcattcagagcataaatgcacaaaatctgttacatgtctcccctcagaagaggttccttgggcatcccccccggggggttct

SEQ ID NO: 46680 - DNA, 121 bp, Homo sapiens
atccaataaaagcattaaattagggatatgtacccagtatattttctcacaggttggactttgcccccaatggccttactggggaacttttacaaaaattaaaaaatgtatttcccggtat

SEQ ID NO: 46681 - DNA, 302 bp, Homo sapiens
ttctctcctttccagtcggagacctctgccgcaaacatgcttcgccagatcatcggtcaggccaaggagcatccgagcttgatccccctctttgtatttattgggactggagctactggagcaacactgtatctcttgcgtctggcattgttcaatccagatgtttgttgggacagagataacccagagccctcggaacaaactggggtgccaatgatcaatacaagttctactcagtgaatgtggattacagcaagctgaaggagggaacgtccagactttctaaatgagaatgtttcact

SEQ ID NO: 46682 - DNA, 296 bp, Homo sapiens
ggtggtgttcgtcttctctctcctcgattgttgcgcgctcatcttcctctcggtctacttcgtatccttgccttaggcaggcgaacgcctttcccgggggacaaggctgagggtggtggggtaattccagaaattgattggccataccattgtcactgtattactgctcatgtcattgcactggttcatcttccttctcaacttacctgttgccacttggaatatatatcgatacattatggtgccgcgtggtaacatagggagtgtttgatccaacagaaatacacaatcggggg

SEQ ID NO: 46683 - DNA, 292 bp, Homo sapiens
ttagcatgtttagcaaaccttgtgaaattataataaggttgtagttacatgtgaaactctaaatgcatggcaactgttaatgtcataacagtttaggtattttgttctgttctgtcatgtgccacaaaatatgtactttggtcacttttttccccttgtatatcaggttacggggtacaacttgttcattctgagaacaacaacaacaaaagtgcattcatatttgggggcacttgtatatgtgcccaagtaattccctacagcctaaaggcgtggcctctgtatgtggctc

SEQ ID NO: 46684 - DNA, 243 bp, Homo sapiens
tcttattactttcaatttaacttgagtcactattaagcaagtttaccaaagtggccacaaagttgatttttaacggtttgtaaagggtttaattgtttataggaggtgcattcaggaaattttggtgtaaatccccgtgaaactcttcaaatatgggactatggagttagggggtaggccctaaaggggtggggtttaaggagatttaaaatattttcccctgagttaaaagagaatatattc

SEQ ID NO: 46685 - DNA, 303 bp, Homo sapiens
acttcaccgaagaccagaccgcagagttcaaggaggccttccagctgtttgaccggacaggtgatggcaagatcctgtacagccagtgttgggatgtgatgaggggccctgggccaggaaccctaccaacggcgaggttcttaaggtccttggggacccaaggggttattagatgaatgtttaaggtgcttgcctttgagcactttctttccatatcttcagagagagggccccaaacacagggcccgggacctctttggggtatttcgcaggggtctgggggtgttacaagagagggaatat

SEQ ID NO: 46686 - DNA, 260 bp, Homo sapiens
ctggcagagcataagtacatccaggttgtctaccttcataacaacaatatctctgtagggtggatcaagtgacttctgcccacctgggacacaacacccaaaagggttcttattcgggtgtgagtcttttcagcaaccccgtcccgtacttggagatacagaccatacaccctcagatgtgtctgacgtgcgctctgtccatttaaatcggggactctaaatgattctcaagggagccctcatatttatatcctcgcaca

SEQ ID NO: 46687 - DNA, 197 bp, Homo sapiens
ccccacgggagccaggatgggacttgtcgtgtttgtgcttttctccaagtcagcacccaaaggtcaatgcacagagaccccgggtgggtgagcgctggcttctcaaacggccgaagttgcctcttttaggaatctctttggaattgggagcacgatgactcttagtttgagctattaaagtacttctaacacattgt

SEQ ID NO: 46688 - DNA, 163 bp, Homo sapiens
aacagttattgaaagggtaatgaatgacggtgtttgctataggtgtgacagaaatggcaggaaatgtgttttaaaaaataaaaaaaattaaagttgggcactttggctcatgcctttaactccgccacttttggggggctgagggggggggggtccgtttaag

SEQ ID NO: 46689 - DNA, 243 bp, Homo sapiens
aactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttgggtacctatgtacctgttaccactttcaaaaatctacagacagtcaatgtggatgagaactaatcgctgatcgtcagatcaaataaagttataaaattaca

SEQ ID NO: 46690 - DNA, 291 bp, Homo sapiens
aataataccacacatctacaactatctgatctttgacaaacctgacaaaaacaagagataggcaaaggattcactatttcaacaaatggtgctgggaaaacttgctagccatatgtagaaagctgaaactttgatctcttcccttgcaccttgtacaaaaattaattcaagatggaattaaagacttcaatgtttgagctctaaaccatataaaccctagaagagaacctttgcattcccattcaggacatatgcataggtagggctttatgtctatgacaccacaagcgg

SEQ ID NO: 46691 - DNA, 269 bp, Homo sapiens
ccacctcaacgtcggtaccgccgcaacttcaattaccgacggagacggccaggaaacccttaaacacaagatggcaaagagacaaaagcagccggttcaacagctgagagattcgtgtcgctctccgaggcttagcagaggcggggctttagttaaatatcccgcttaccatactctatccatcataccgcggttagttataccaacacgcagagatatggatttcacgcgctatgagatgttcacacgattgagctctggagctctag

SEQ ID NO: 46692 - DNA, 217 bp, Homo sapiens
tggccttctcagcctacagcagtgtggtctcttacatggccacaaagggacacacagtgacaaaaggctcggaatgttacaatggtaaaatgagttatcttaaattcacttacaggtattaaatagggttagagagggaaagcttcctctgggcaagtaggttatatgcagcatgaatttcaactcactttttttacacactctccactctctatgt

SEQ ID NO: 46693 - DNA, 221 bp, Homo sapiens
ctctttcattctggacagctcacaaatagttaatggaccatgctttgaatagccttcctctaagcaacatttataaatactgatattttaggactgtttacaattcttctgtttatttttgaattttcagtttgatatcttgtccctattcaatgttgtataaacaaccgtacttttaatttcacggaggattaaaaggatttcacttcaggtttgggggg

SEQ ID NO: 46694 - DNA, 290 bp, Homo sapiens
  misc_feature 252: n = A,T,C or G
aaaggaggaagttctgacttttcagggctaccttatttctactaaggacccagagcagggctgtccatgccatttcttcgcacagatgaaactgagcttggacttgaaaggacagcccttgacctggggtctggggataatttgcacttttgagacttgtagctaaccatcttatgagtggcccatgtgtcattttagtgaaaacttaaatagagacaaggtgctccaaatatttcctctttgccccaaagnttaaggggggttttttagagaaaagtgtacaataattt

SEQ ID NO: 46695 - DNA, 222 bp, Homo sapiens
atttttcgtcaaggttttggttggcacatggggcaaaggccctcagaattcatcgttttgctataaatctattggaattgccagggcaaaaccattctttgcctatactccttataaatgggattcttagcttcgatctaacaaaacttagcagggtagcccttaaacataattctgatgatttaaataattcgccctagcccggattacacacaaaagggg

SEQ ID NO: 46696 - DNA, 141 bp, Homo sapiens
aaggcccagccatgtctgtggtcttgtttcccttgggcttcttgctgctggagttctggcctgcctgccctggcctctcttgctccggaggttcttttggtccccctttctccccttccgggggggtggtttcttctcccg

SEQ ID NO: 46697 - DNA, 183 bp, Homo sapiens
aatactgtaggaacaagcatgatcttgttactgtgatattttaaatatccacagtactcactttttccaaatgatcctagtaattgcctagaaatatctttctcttacctgttatttatcaatttttcccagtatttttatacgggaaaattttttttaaaacactttgtgtccagttggtta

SEQ ID NO: 46698 - DNA, 125 bp, Homo sapiens
gctgtgagactacctattgtagatattgcaccctatgacattggtggttctgatcaagaattttggtgttggacggttggccctgtttttctttttataaaaccaaactctatctgtaaattccc

SEQ ID NO: 46699 - DNA, 166 bp, Homo sapiens
actcaaattggtcagaattgtgtccagaatgtgctcagctaattcagtattcttccccattcttggggtggaaggtttacttgcagggtaatttcttacaggttgctgagtgtcaaagactgttacctgttcttcgggctttgaaatccccgcctcaggacaaaga

SEQ ID NO: 46700 - DNA, 268 bp, Homo sapiens
agcctgtgtaaaaaggcaggtgattccgtaggctcttttcctgcactaaccagtgccagttaatacctcaactttcatggaccagcaaacctcatggcaacaattagtgtgatttaaatggtgggggcgaagtggtttacgcgccccgaaatccaaagtctctttgggggggccaagggcgggtggttacccctaggggttcggtgttacaagacgcgcctcgccaacatagtgaaaccccatctctactaaaaatacacaatttgag

SEQ ID NO: 46701 - DNA, 200 bp, Homo sapiens
gaagccttggacgctgcaggtgataaacttgtagtagttgacttctcagccacgtggtgtgggccttgcaaaatgatcaaggccttctttcaatcccctctctgaaaaggaattccacggggaaaattcctaaaagttgagtgtggatacctccaggatgtggctccagagtgtgaagtcaaatgcatgccaacattcca

SEQ ID NO: 46702 - DNA, 152 bp, Homo sapiens
tttctattgaatattatcatggttttacaatattttccctagacaccttaaaagaactgaaggacttgagagctagataaggaatagatgaggggaggggagacaaaagaaaaaccctaataaaaaggggggcccccaaaagggccctttta

SEQ ID NO: 46703 - DNA, 130 bp, Homo sapiens
attctccgagcttcgcaatgccgcctaaggacgacaggaagaagaaggacgctggaaagtcggccaagaaagacaaagacccagtgaacaaatcccggggggaaggccaaaaagaaggagggggtcccaa

SEQ ID NO: 46704 - DNA, 100 bp, Homo sapiens
agacagttggggatgtcacttatcattgtgtttgtgagcaattttgagggaaccgagccaggctcaatattaaacggtcacttatacgggggacgaggag

SEQ ID NO: 46705 - DNA, 464 bp, Homo sapiens
aaagatagagaataatacaacgacttaaaaaacatagtcaataggttactaagatattgcttagcggtaagtttttaacgtaattctaatagctgaagattctaagagaaaatatgaagacttagaagagtagcatgaggaaggaaaagataaaaggttctaaaacatgacggaggttgagatgaagctcttcatggagtaaaaaatgaatttaaaagaaaattgagagaaaggactacagagccccgaattaataccaatagaagggcactgcttttagattaaaatgaagggacttaaacagcctaaaggttaggttaaaagtggaggggataaaataattggaggcgatctttaaaaagagataaaccgaggggataaaaagaccttggaaaccatgacgcagggagaatgcgcatttaaagcctaggtaacgcattactaacgcaaaaaaaaaaaaaaaa

SEQ ID NO: 46706 - DNA, 142 bp, Homo sapiens
tggaaactcattctctaggggaagattggaaatttcgctctttatcaattattttgctttttaaaacaattttattgacttaaaatttttaaaattgcttttaataattgtataggttacttttttctgtatgttgaaaaaa

SEQ ID NO: 46707 - DNA, 424 bp, Homo sapiens
gaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggccaaagatctctttcgtgattccttgcaacaatcaatgagaatcttcatgtattctggagaacaccattcctgatttcccacaaactgcactacatcagtataactgcatttctagttctatatagtgcaa

SEQ ID NO: 46708 - DNA, 254 bp, Homo sapiens
ttgagtgagatgtccgcaaggtagtgcgagagaaaggcgtctgcatcacgaggtaccgagatacacatcacattcacagcgcatacttggagtgggcttcagaagcgtgcacctcgggcactcacagagattcggacatttgccatgtaaggagatgggaactccagatgtgcgcattgacaccacgctcacacagctgtcttgggccacaggcataaggcatgtgccataccgcatccgtgtgcggctgtcca

SEQ ID NO: 46709 - DNA, 105 bp, Homo sapiens
  misc_feature 15, 32, 33: n = A,T,C or G
aatactatgaacatntgaatattaagatatanntgcacataattcatattcaggtggtattgcatcagtgccttactggtattttcagaccattttcattgattt

SEQ ID NO: 46710 - DNA, 151 bp, Homo sapiens
  misc_feature 29, 52: n = A,T,C or G
tgttcagtttcattctgtattctcagtantatttcttattcatatacatttngtgtacaactggtttaataagcggcaaaccatatgctataggctatgcaggtcatccattctgtaaggtctctgtggcaagtctttcaatagggatact

SEQ ID NO: 46711 - DNA, 193 bp, Homo sapiens
atttaaggatggtttagaaatggaaaaatgttaacaaatgtggcaattattttggatctatcacctgtcatcataactggcttctgcttgtcatccacacaacaccagggcttaagacaaatggggctgatgtcatcttgagctcttcatttattttgactgtcatttatttgggggggggggcatttttttt

SEQ ID NO: 46712 - DNA, 160 bp, Homo sapiens
agagctcgtctccagaagaattgcgaagtcttcttcaaaaacgctatgaacttctagagcacaaaaagaggtgggcttctatgtcttgatgaataacggacagcatatttcgcacacacacgggaggagctgaaaaagaagttgaaggaaaaagccaaaa

SEQ ID NO: 46713 - DNA, 119 bp, Homo sapiens
ggcggcggaggccttggcagcctggggcttagttcaagactctagcatgtaccctctaggggccctccaggcgctcttcttgtcagtcttggcagccggctctggccaatttcgggggg

SEQ ID NO: 46714 - DNA, 157 bp, Homo sapiens
  misc_feature 25, 26, 37, 135, 136: n = A,T,C or G
aaaggagaaaaaaaaccttgtaaannagcaaaattgncaacagaaaacaattttattccgagcattccagtaacttttactgtgtatgtacttagctgtactataagtaggttggtttgtattgagatggttaannaggccaaaggttaaagggttt

SEQ ID NO: 46715 - DNA, 170 bp, Homo sapiens
atcttctttataatctactttgagtgctgtctccagtttgatgtatctgagcaggttgctccacaggtagctttaggagggctggcaacttagaggttggggaccaaagattttttttttcccaacaataacaatttcgggcaactttggaacctttccaattttttgcv

SEQ ID NO: 46716 - DNA, 134 bp, Homo sapiens
  misc_feature 34: n = A,T,C or G
tggagatgaccaatggatttcaaatcaacaccgntgagattatgacttaactcaagtctgttaattgacacatagaagcctcattagtcctgatgggtcctcgaaaaggccccgatagaccctacagagccctv

SEQ ID NO: 46717 - DNA, 115 bp, Homo sapiens
aactctaggatttaggcatgtcaacttctgttgtgtcttgaatctctccagagttgcatgtagatagcatttatctctgtgcccttaaacccatttagacacatgcctatacagg

SEQ ID NO: 46718 - DNA, 203 bp, Homo sapiens
  misc_feature 37, 38: n = A,T,C or G
cgggtggggaacatgtctgagtcggagctcggcaggnngtgggaccggtgtcattggcggatgcggtcgtgaagataggtactggttttcgattaggcattttttttctcacctaccttctctaacagaagaatgtggccattagctttcgggttctcgcatgggattaggaattgcttattcccacctctcaaccatgatty

SEQ ID NO: 46719 - DNA, 215 bp, Homo sapiens
ggggaaacttaaagatgcttcgaaaagcctggaaagagcaactcagttgtaacttggggaagttaacgatccgcccgagtgcagaggaaaaccagaaacgccttgccttcagctgaaccaccgtttgttgcgagctggatgtccttttcaggagataggaattttccttttgaattgataccattcatcaattttgacactttaaagacgtgtgr

SEQ ID NO: 46720 - DNA, 237 bp, Homo sapiens
tggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttgtctaataccgtggatggtgggaattcgggaaaataaccagtttttatctgagatcaattaacagtgtatttgtctctgtaaataa

SEQ ID NO: 46721 - DNA, 255 bp, Homo sapiens
tttctcattaaaaggaatccagttatttgaccgtataaaattatttgggaatgcctgctaagcatcagcctgatttgatatacctccgttatgtgccgctctggaaggtccatattttcacagtcattcagcttacttgtttgggcccttttatgggtgataaaagattcagctgctgcagttgtttttcccatgatggttcttgcattagtgtttgtgcgcagactcatgtgacctgtgtttcacggagagaga

SEQ ID NO: 46722 - DNA, 116 bp, Homo sapiens
aatactctcttggcagcatttttggaaggtattattagcataatactcgctgatggtttacatagcattcacaatactagcttctcatcctctgaagttgacagtgctgtaaggac

SEQ ID NO: 46723 - DNA, 243 bp, Homo sapiens
ttcacagtcacttcacttttaaggaggtagagtcagatgtcctggaaaataagggaaaactaaaagacaatgacaatgacagccaaaatggatctctttgtgaaatatgttcagagcattagagagtagagtaaaatggtaattcacagactcctcacccatgacttgcatattttgtgagcaggttagtctttttccatctattgagtcagaatctgggtgagtcacacacttcaggtgaca

SEQ ID NO: 46724 - DNA, 125 bp, Homo sapiens
ttgtgccatcagtctttgttcgttcagctagctgcgtgtatgccgtggtttgcgcgtaccttttgtgtggatgatgacctgtgtgagaaacacgagtgtcagcaatgctgctgtgtgcgcgcgca

SEQ ID NO: 46725 - DNA, 143 bp, Homo sapiens
tgccttgagtttcatcagaattattggcctagtaatccttcagaacaccgtaattctcaatcacctcttcccatacacctttcccccataggatgtgtcttcacactatacgcatttgtgttgtgcatttgattagtcatata

SEQ ID NO: 46726 - DNA, 233 bp, Homo sapiens
ggttgtggctgctgctccgcagtgtcgggcagatggcgccgccggtcggcagagagggggctaaagagcgtcgtgtggcagaagataaaagcaacagtgtttgatgactgcaagacagaaggcgaatggcagataatgcttttagatgaatttaccactaagctttttgcatcgctgttgcaaaatgacagatcttctagagaggtattactgttgtagagactatttatcag

SEQ ID NO: 46727 - DNA, 233 bp, Homo sapiens
ctctttgcggcgctacactagagcagagtacgagtctaggcggagggagtaatggcaggacaagcgtttagaaagtttcttccactctttgaccgagtattggttgaaaggagttctgctgaaactgtaaccaaaggaggcattatgcttccagaaaaaatctcaaggcaaagtattgcaagcaacaagtagtcgctggttggatccgggtcttaaaggaaaaggtgtgagaa

SEQ ID NO: 46728 - DNA, 207 bp, Homo sapiens
ccggggacgttgtctgcaggcactcagaatggtccagcgtttgacataccgacgtaggctttcctacaatacagcctctaacaaaactaggctgtcccgaacccctgggtaatagacttgtttacctttataccaagaaggttgggaaagcaccaaaatctgcatgttggtgtgtgcccacggcagacttcgaggggttcgtgctgt

SEQ ID NO: 46729 - DNA, 176 bp, Homo sapiens
aagatagggaataatgaatactggtggaaggatgtggagaatggggaaccctcgtacactgtcaatgagaatgtaaattagtacagccactatggaaaactgtattggaggtgcctccgaaaacaaagtagaactaccatgtgatacagcaattacaatagttgatatatattcaa

SEQ ID NO: 46730 - DNA, 313 bp, Homo sapiens
cagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttcccatctgtgtcctactacaggagaataattgaaggcactgaagttgtccacggtaattcagaataagcagatagtaggaccacgtgatgacacccctcggcaggggcccagagtg

SEQ ID NO: 46731 - DNA, 129 bp, Homo sapiens
gatcccaaatcaattactttaacctttaccttaagacgctaataaaataacagtaaagtatatccaaaataaataggaagaaaataataaagttaagaataaagatcaataaaatgaaaaacaataaaa

SEQ ID NO: 46732 - DNA, 164 bp, Homo sapiens
aagagatattaatgtgcattaccctatcttgtttttgaagccagggtagttgtatgattttgttaccagcagtgctaacctgaatgtgacctcggttaccttggaaatgcaggaacttatatgaatgtactataaaataaaatgcgggctgattcccaggattc

SEQ ID NO: 46733 - DNA, 211 bp, Homo sapiens
tttccctggtgtctacattttacagaggaaagcacgaactaaataaagggggaaaagcaaacaggccaagtttacacagctaagaaaaagagcagagcagggctagaaacctaaatcagattggacttaaaacttcacacttccaaacactatgctgtatttcttggcaatgagtctgagtaacaggtcaccaccagtaaagagaaatttc

SEQ ID NO: 46734 - DNA, 179 bp, Homo sapiens
ccatctggagctggtgctataggtgaccatctggtacattgaggggacctgtttgcctcctccactctataagcaggtcatcttgggagacccgggaggggaaggtggtgggcctagtcctgtttcccccctccatttccccatgcctttatgttccccatctgtgtctcctgtcaaga

SEQ ID NO: 46735 - DNA, 217 bp, Homo sapiens
aaattctgaagaatctaagccaggttgcaatgaggtgtcgctgcagcagcatgcacttcttggtagcagaatggaatgaaccatccatcaacttctattaaaagaagaggtgcttctgatctgtccagtgaagagggtttgagacttttcaagatcgacaaggagtactttctaaaatggcaacagagggagtgaggagtgctggctgtagatgaca

SEQ ID NO: 46736 - DNA, 215 bp, Homo sapiens
aagtagacagtggctggtatggctctgaggctccctggggcctgctcaagctcctcctgctccttgctgttttctgatgatttggggcttgggagtccctttgtcctcatctgagacttaaatgtggggatccaggatggccttccttcctcttacccttcctccctcagactgcaaactctatcctcggaacctctcctccctttctccccaac

SEQ ID NO: 46737 - DNA, 211 bp, Homo sapiens
tcaggccttagcaaaatactgtaagcacaagacctccttctccctatttgtttaggaccatgagggacttatatttctaccccttttttttttgagatggagtttgcgttttttttgcccaaagcttgaattaaattggatataccctggggtcactctcaacctctatcctcccccagatcaagggggggctcccggccccagactcccc

SEQ ID NO: 46738 - DNA, 270 bp, Homo sapiens
agtaatttacaaacctctcagcacctaatttagtgtccactccaagtgggtcaattccctaggtataatttttaaggccttactggtatccactggcttttcccccttggcttaaatgactcacttggagttttatcctctaattttaaagggacctgtccctatctgggtgtctaaacacactattctccagaaaaacccactcatttccgggccctctcccaaagcccttattgtcccacaccactacatggcacacatctctgtacc

SEQ ID NO: 46739 - DNA, 198 bp, Homo sapiens
tcccacttttgaacaagctgatgattctgaaactggcccaatttcctaacaaggcggatggttgagaaaacctaaaattgggcaatgaggagggtgtctcctgtcgggccttcgggccacactccctctttcccttggggctccccccttttcttttttagaactattataaaacccacaaaatttagtggcggagag

SEQ ID NO: 46740 - DNA, 247 bp, Homo sapiens
cgccgttctggtaaaagctggaagatggcctaattcttgaagtctggtgatgctgccattgttgatattggttcctggcaagcccatgtgtgtttgagagcttctcagactatacaccctttgggcggtttgctgttcgggatataagacagacaggttcggttggggtcacaaaagaagggggcaagaaggcttttggggcttgggaagggcaccagtttgtccccgaagggctaagggtcaaagt

SEQ ID NO: 46741 - DNA, 262 bp, Homo sapiens
gaatatcgaacacgcaaggctgtgagactacctattgtagatattgcaccctatgacatttggcggttcctgattcaaggattttggtgttggccggttggccctttttgttttttattaaaccaaacctatatctggaaatccccacccaaaaaaaatttacctcccatatgtgttcccctggtctctaatctggtcacccagtgcaggtgccccacaaattcccagttatttattcccaaaatgtttggacacagtatat

SEQ ID NO: 46742 - DNA, 155 bp, Homo sapiens
cscaattgactaacagcctggagcttcagctatggcaaccccggagagtctaaaggttgagccgagaaagagcctgatgccagtagctcaggacgcatttgacctagacagcccctatatttatttaggtccggtaaaaaaatccaacttaggct

SEQ ID NO: 46743 - DNA, 165 bp, Homo sapiens
tctctacagagtgaaggtttaaatccaaggtcatggcaaacatctgaaggtcatcgccaaggctgtggttggacaaggaggggacggtggaaggcgattacaaggcccctaaacagggattcctaaatatggatgggcaaaattggagcccataaggattggggg

SEQ ID NO: 46744 - DNA, 177 bp, Homo sapiens
gaacataaatgcacaaaatctgtacatgtcttccatcagaaagatcattgcatgccacagggattctccttccttcaaacctgtaaagggcaacaattaaaacccaattatggggtttgcttttttttcacatggggcagagggatggggttggaattttaccttttaaagtgtgat

SEQ ID NO: 46745 - DNA, 235 bp, Homo sapiens
caggcggagttgaggaaaccgccagataagtttttttctctgtgaaagatagagattaatacaacctaccttaaaaaaatattaggtcaataggggttactaagggtaattgccttagggggttaaggtttttaaacggtaattttaaataggcttaagggtttttaagggagaaatatttgagggcttagagagggagaagctttgaggaaaggaaaagataaaaaaggttctc

SEQ ID NO: 46746 - DNA, 216 bp, Homo sapiens
aagcctagttaacgcatttactaaacgcagacgaaaatggaaagattaattgggagtggtaggatgaaacaattttggagaagataagaagttttgaagttggaaaccctggaagacaaaaagtttgggggaaggccggaagaaaaggtattgggaagtttggggaaattttggaggtttaaaacatttactttttggggggaaaagggtttattt

SEQ ID NO: 46747 - DNA, 271 bp, Homo sapiens
taaactctaatttagttcctcaacatattttcagtgtttatgcagacctttagagttaaggcctttgtatttccatgttattccacaatatggcaatatttctctgagaaagccctctgctatgtataatcctatgtgaggaaagggggcaaccttctgtccccacatagaggggggatttcagcccaggtatgtgagaaaaagtgagagcacatttcccagcacatgggtcgcgtgttctcttgtgcccaaatagtactcctggcagggc

SEQ ID NO: 46748 - DNA, 206 bp, Homo sapiens
tgcctcccaaaggtgctgagattacaggcataagcagtgcacccagccgagaattagtatttttatgtattgttaaaaccttggcgtctagccataattttatgtcataataaaatgggtttgtgtaagggaaagagtttcctgaggtaactctttgaaggtattttggggtaaagcatctcaaaacattatctttcccaaatggg

SEQ ID NO: 46749 - DNA, 216 bp, Homo sapiens
gtctaggacatcaccttgctgtgtcttctcaagcttttaaaattgaccctgaacgtgtgacaaggtcctatggtgttaatcaaagctgtgcagggtaaatgatgaccaatttattctttttccaattgttctagaaacagtgcctttttcataagttgcattttccaggctgagagctgtataaaaaattttgggctgtgaccctttaccctcctt

SEQ ID NO: 46750 - DNA, 212 bp, Homo sapiens
tacagatgctaaatacagtgatacaatatttggaatctatcataatggagctacaacagcacataaaaaggtacattagggctagacttcaaggacctgagggtttggggttacctgtaaggtctaggaattttctgacttctcttaaggttctggctaggttggggcctctggtcacccgtttcctgtcttgaggaaactttttgttctga

SEQ ID NO: 46751 - DNA, 229 bp, Homo sapiens
ttagctgtgctcgcgctactctctctttcttgctgagctatcagcgacttcaaagaattaggtttattaatttcatccagaaagagattggaaagaacacatttccctgaattttcatatgtgtctgggttcacatccatccgcacattgcagggttgactcactgcaggagtgggagagagatttgacaaagtgggagcatacagacttgtctctcagcaagggctgg

SEQ ID NO: 46752 - DNA, 357 bp, Homo sapiens
aaagattcaggtttactcacgtcatccagcagagaatggaaagtcaaatttcctgaattgctatgtgtctgggtttcatccatccgacattgaggttgacttacggaggactggagagagaattgaaaaagttgagcatttcagaacttctctttcagcatggacctggatctagcactctctggaacatagctgaagttaccccacctgagacaggtgatgttgcctaccgtgtgaaccactgtgacctttgtacagcccaggataggtatgttgggatccagacatgtaaggagcttatggaggtttgacgatgcccatttggattggatgaattcccaatcggcttgcttgctt

SEQ ID NO: 46753 - DNA, 224 bp, Homo sapiens
  misc_feature 173: n = A,T,C or G
aagagagggaacctcatctaagtaacatttgcacatgatacagcaaaaggagttcattgcaatactgtctttggatattgtttcagtactgggtgtttaaaggacaaatagctgctagaattcaggggtaaatgtcagtgttcagaaaacgtcagtacattttggggtttttncctgatttgttgctccctatgcagcctaggcaacagtaactcttgtgttca

SEQ ID NO: 46754 - DNA, 176 bp, Homo sapiens
attttgtgatacgtaactttcaaattattcagaaaatctatgtgtttagagaagaaaaatatggggcaaaatattagtaattgcttgtgtttgagtagagtacacaggacttcattgtattattactcctaactttgcctgaaagttcaaagttacttccaactagagagctaaaa

SEQ ID NO: 46755 - DNA, 221 bp, Homo sapiens
  misc_feature 12: n = A,T,C or G
agataatttttngcttagggcctggtggctaggtcggatctctactatccagtcggagacctctgccgcaaacatgctccgccagatcatcggtcaggccaaggtgcatccgagcttgatccccctctttgtatttgttggtctggggctactggggctacactgtatctcttgcgtctggcattgttcgtcccgatgtttgttgggccgatctgtccctg

SEQ ID NO: 46756 - DNA, 206 bp, Homo sapiens
ccccagccttctcgcctctccgctggtcttcccgtcctccctccttccgtgggtccttcgtgtgccccggggctgtggttcggtcctggttcctcgccctgtgcgtctgcgtttctctgtgtccgtgtctgtctgtgtctctgcgtgcctttcgccgctcgtttgctcttggcctcctgtcgctctgtctgcctctcgcccctctc

SEQ ID NO: 46757 - DNA, 357 bp, Homo sapiens
cctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaattttgcatgttgtgttgtgcccaggcagacttcgaggggttcgtgctttaagaactaaagttcttatgagattgtccaaaacagagaaacatgtcagcaggggctattgtggttccatgtgtgctaaatgtgttcgtgacaggatcaagcgtgcttttcttatcgaggagcagaaaatcgttgtgaaagtgttk

SEQ ID NO: 46758 - DNA, 233 bp, Homo sapiens
caacattagctgattggtacctatcagtattatggtgattctgttagtttatagatctgtgcaacatttttgtactgtatgtcttcaaacctggcagtattaatacccttcttactgacatatgtactggtaggtttagaaaacttttatatttgtgtgtcttattggtatattgagttatttattacacagtgtagtgtataatactgtagtttgtattaatacagtagtat

SEQ ID NO: 46759 - DNA, 125 bp, Homo sapiens
aagcaggtaatatcaaagtattggaaagctagcatgcatgccctcttacctgggtatcttcccccttggccccttttaaactcttgagcctcctataacgaaggattatgtgtttcaaacctttt

SEQ ID NO: 46760 - DNA, 216 bp, Homo sapiens
tggggacaatgttagaagtgtggaagtggtaggattcaatatccttgtgcctaatccccagtttcatgggcataagaggcttaaagttttaatagcaggagcatctttttgacccaggattgcagaaatgattgcgtgcctttgaattcaagaactcaaaaccttcctccatgccacagctactttagttatttgcagaccttccattgtatatgk

SEQ ID NO: 46761 - DNA, 144 bp, Homo sapiens
aatgttttgtggaccactttggttttcttttttgcgtgtggcagttttaagttattagtttttaaaatcagtactttttaatggaacaacttgaccaaaatttgtcacagaattttgagacccattaaaaaagttaaatgggag

SEQ ID NO: 46762 - DNA, 176 bp, Homo sapiens
cgtctgtcctgcgccaagatgcttcaaagtattattaaaaacgtatggatccccatgaaagccctactacaccaaaggttaccacggagattttggataaggaattggggcttattgggctttaatctgttttataaaattccggggcttgcttataaagggaggtaaaggctttt

SEQ ID NO: 46763 - DNA, 212 bp, Homo sapiens
tagatgatctgcctttcaggttatctcaagggcagtttcacctttccataatataaatgtgacccttagatattaagggtattattctttccttcttcctggttaggcccttttcctggggtttgccttaccgggcttcccccatatatggacaggatgatatcaggtattttttaggcctattttagtagagtaccggggggggacccact

SEQ ID NO: 46764 - DNA, 113 bp, Homo sapiens
gtaaaagaggcgccttaaataggtttttaaggaattaaagtaggtgaaattcaattttttggggccccccttatttattacatttttttgctctttgtgggaaaaaggggttt

SEQ ID NO: 46765 - DNA, 230 bp, Homo sapiens
aacttgtgaacaggaagaacttgaggaattaaaatcttcttattggaacctcttgaaaaagagattgttagggggagagaaatttagaaagagggccccacctgtatgctggggggtgtcttttggaaaaaatatgaaatggaaattttttgggagaagtttttttcccctttggtgtggtgttgccctttgggagagagaagatttgggggagaggccccctctggggg

SEQ ID NO: 46766 - DNA, 146 bp, Homo sapiens
ttggattaatagaaagaatatgaccaaccaaatcaatgttttgggataatattaccaaaatttttggtaagagaatgaaccaaacaattttgctttgaattaaatgtttttcccccaataatttaagggcaacaaaatcttcttga

SEQ ID NO: 46767 - DNA, 181 bp, Homo sapiens
acctgctggacgaaaccatgaagagcctgatccttcttgccattctggccgccttagcggtagtaactttgtgttatgaatcacatgaaagcatggaatcttatgaactttatcccttcattaacaggggaagatgcaaatatccttaatatcccctcgggcagggatggggagctatagt

SEQ ID NO: 46768 - DNA, 172 bp, Homo sapiens
ccttttgcaaaggatcttcttcatccctctcccagaagaggagaagaggacacacaaggaggaacggctttgtttcagggcgcccaatttcttcttcattggtgtgtaaattccccaggtttctatataaatcacacacgcggctttagggcatatcacacaacccggagag

SEQ ID NO: 46769 - DNA, 190 bp, Homo sapiens
ttgtccaatttatctgatctgtgattaaaggaggaatattttgagaaggactgggaaaacaacaacttcttaaggtaggaaattagggattggttttttaaatccccacagtttatcccctaagtctttggaaggattaaaactcttgtgagagytctcacacccggggtaaaggtgtaaaaatggtttt

SEQ ID NO: 46770 - DNA, 252 bp, Homo sapiens
tgtaactgagaaatatttttaaaaaccaattaaaagagaagtaatttggtgggtactttaaggattgtaggtaggaattgatgtataatggggtgctcccagtctttgtatgaaaaattaaaactctctagtgctctaatgagcatgaatttatacttctacacataggcgcttagtgaaatactactcagagttttgaggtatagagagatatggtgtattttacgtcggagcgctcttaaagtggggtga

SEQ ID NO: 46771 - DNA, 124 bp, Homo sapiens
atttcaaataagagctatagagttagacggggaaacaatcaagcttcagatattggacacagcaggcccgggtaggtttcggaccatcacctcccgtttttttcaggggggcccctggcttcta

SEQ ID NO: 46772 - DNA, 114 bp, Homo sapiens
  misc_feature 25, 26, 64: n = A,T,C or G
gatactgtacaatctggacttacannggggagtaataatgtatactaaatgacttttgtatctnaggtactttgtgagtagtgaatttttgttgtttttcttgtcagctacaca

SEQ ID NO: 46773 - DNA, 365 bp, Homo sapiens
aatctggtccgagagaggtaaatgaggcactggtggtgtctgaattgaaatcaggggaacctgacaccccgacaacaaatggtgtaattcatgttggagataaactcctctatccagcagacacacctgttggaaatgatcaactgctggaaatacttaataaattaatcaaatacatccaaattaaggttggtcggggccgcaccttcaaagaaatcccgggactggctataagccaattattaaaaaatacaccaaaatcattgatggagtgcctgtgggaataaccggaaaagagccccgggaggacggatccttaccggtccggaataaaatccccggggtcctaccggaggtggagaacc

SEQ ID NO: 46774 - DNA, 354 bp, Homo sapiens
aaaggtaactacataggtaaatatgaaatataggataaatgtttttttgggttgcaattcttttcctgtctgacctgttagacaactacataaagcagtacttatgaaataacgctgatagggttataacttataaaagatgcagtttgtatgatgataatagcacaaaggaggaggaagggaatagagctataccaaagtttttgagtattattgaaattaggttggcattaatctgaacctactttatgtaagatattaatcatagccctagggcaacctctaggaaaaaaaactcaaaaaatcaataagagggacaagaagggaatcaaaatgatttccttggaaaaaaaa

SEQ ID NO: 46775 - DNA, 99 bp, Homo sapiens
caagaggtgcgggagagtgcatatggctagcgagaggaaaggtttggacaggcgcggggagggccgacaggggggtttcctatgaaaacagggagcggg

SEQ ID NO: 46776 - DNA, 434 bp, Homo sapiens
tttaaggaggtagagtcagatgtcctggaaaataagggaaaactaaaagaaaatgaaaatgaaagccaaaatggatctctttgtgaaatatgttcagagcattagagagtagagtaaaatggtaattcacagaactcctcacccatgaaatgaatattttgtgagcaggttagtctttttccatctattgagtcagaatctgggtgagtcacacacttcaggtgacagatgccaaaacaccctcaaaattaaccaaagggtgctgcttagccttgcaaagcaaatacaaatattcaaacaaacatctctccaaaaggcacctctccactttccgctaactaaccgctgtgctatgctttacctagagccccgtgcttgggatgggaacagacgggtcctgcgcagccctattattttctgtcagaagcctgatg

SEQ ID NO: 46777 - DNA, 195 bp, Homo sapiens
agagaagggagggagaggctgcagtgcgccgagatagagttagagcgctccagcctgggcaaaagagaatactttggaaaaaaaaaggaaggaagggagggagggaaccaaccatgccaacaaagtgatctggggactactactggactacgagcctccagaactatgaaagaatacatttctgacggctaagcc

SEQ ID NO: 46778 - DNA, 233 bp, Homo sapiens
gtacagggatccttcggggcccgagggtgattgctttactaacttgccctttctgccgttttggctttcagcatttctgtgttacatctgcaagggatacgtagaggatctggccaaaatccccaggggtttcttacaagaggcaaatgtcacccttatagtgattggacagtcatccaaccatcatattgggcccttttgcaagctgactgggtattctcatgaaatctatk

SEQ ID NO: 46779 - DNA, 198 bp, Homo sapiens
actatgatatcattattttgatatcaaaacacacaaagacagcacaaaggtaggaaggaagggagggaggaaggaggcagggacagaggaaagaaccttgtcaggctgtattttgtctcataagccttagaatggaaaaactcctcaagagcagtgttcagcaaatcacatttggtggtgcataaacaggggtggtgg

SEQ ID NO: 46780 - DNA, 142 bp, Homo sapiens
  misc_feature 28: n = A,T,C or G
aaagaattaggatttcatttatggcgtnatgacccttgggtgaattttctcatcctatttagaaataatccaggaatcataatttcaacctatgtcaagatagattccgggaatatatctgcaggtggatagcgaaaaaaaa

SEQ ID NO: 46781 - DNA, 126 bp, Homo sapiens
aagaaagtaagcctatagtttttggtttgctttaagacggagtcttgcctctttgaacccacggctggcatgcatctcagctcaatacaagcttggcttccggggttcaagccggtctacggattc

SEQ ID NO: 46782 - DNA, 322 bp, Homo sapiens
gctaaagctccatgaaggggctgggaaccgacgaggactctctcattgagatcatctgctccagagcaccaggagctgcaggaagtgactggggccgccagggcaatgtacacaggcttatctctgagagaggacatatattttcggacacatctctgtgactctccgcaaagctgataggttgccctcgcataagggtagaagagcagaggatcgctctgtcattgattatgaactgattgaccaggatgctcgggatctctatgacgctcgagtgaagaggaaaggaactgatgttcccaagtggatcagcatcatgacc

SEQ ID NO: 46783 - DNA, 321 bp, Homo sapiens
gactcattcctccatgttttcttcccttatcttactgtcattgtcctaaaaccttattttagaaaattgatcagtacatgtgcatgttggctacttttggtatactctcaggccttcttcacatctgaacttaggttgagtttgtcaaatgaggggacatcttggtatggctctcttaaagtagtcttctttaggactctcagcatgttgttgttgagtgtggagttgtactctgcgtagactatagacagtcacactatgtacttacgggtggcactattgcagagcgggtgtattatccaaggtactcgtacactattt

SEQ ID NO: 46784 - DNA, 207 bp, Homo sapiens
taacagatactcaggtgcatagtagtatgatattcagctagttttttgtttgcatgaggaaagttatatatcagtctcacagacttggtattgaatattcttcgttggcaaaggttaggaggggtaaccaatattgttttcgggcaagttttgcttactttttcggtaccacaataacagcaatatgatctctagggtaccctacct

SEQ ID NO: 46785 - DNA, 121 bp, Homo sapiens
ctcacactctttatgatacacactgtgttatattcttggactcctagcccatctgcagagcaatgactgtgctcaccagtaaaaggtaagcctttcgtttctggcaataggcaaatccggg

SEQ ID NO: 46786 - DNA, 124 bp, Homo sapiens
tagctgtgtagtctccttccatagctgctctgagggggctggcaacatggctcagcaggcttgcccagagccatggcatagatggaccttgttaatttgcatcccaggggaacacccttactcc

SEQ ID NO: 46787 - DNA, 196 bp, Homo sapiens
ttgcacatttctatatgagtgggtttactggtaaattatgctatttgcgacaactaattttgtactctcagagtgtgtgtcatatgcttcttgcaatgcatatttgttgctctcaaacggttcaatgaaaccacttttgaggtattcaggggattacctcgaattggggcattcaggaagactcgaagatttcagt

SEQ ID NO: 46788 - DNA, 110 bp, Homo sapiens
  misc_feature 104: n = A,T,C or G
agtaaacaggaacatgacgttgatcatttgggcaaattttacgtaaagagaagagcatttattgtgtttggacattaattgtgagatgggatttctcaattttnttattt

SEQ ID NO: 46789 - DNA, 117 bp, Homo sapiens
attccttaaccctggaggcagaggtttcagctagccaagatcacaccgcatcaccgtcagccctggcgacagagacagacactgtctataaaaaaaaaaaaaaaaaaaaaaaaaaaa

SEQ ID NO: 46790 - DNA, 177 bp, Homo sapiens
  misc_feature 17: n = A,T,C or G
atttttgttctctctgnacctcggcctgcatcctggctgcctgtttggtcacatgctagggccacatgagccttccttcaggctctgtggtactctgccaaatgtgctaaggtctgatccctaaactttcttttggatggtttctgtttcgaaggccgacctgctgctctagatggg

SEQ ID NO: 46791 - DNA, 183 bp, Homo sapiens
catacgcatagactgtaagataaagtataggactcttgcaaggtaatacttatttgcaagtcgctatgtgttcactctcctctacctttatgggatttcgggtgttcacttacgatgcatacaactagaaccatatccaagcagactatgggtagctgttaacccagggcctagacttctagd

SEQ ID NO: 46792 - DNA, 253 bp, Homo sapiens
  misc_feature 36: n = A,T,C or G
caacagaatcagcagagttgatgcagctagcctgancaggactgaactaatttggctaaggttgggattgagtttcaacagcatctctgctgttgacaatggctctctggccaacacggctcatctgagggagcttcacttggacaacaacaagcttaccagagtaccttagtgggcttgcagaacataagtacatccaggttgtctaccttcataacaacaatatctctgtagggtgggtcaagggactttt

SEQ ID NO: 46793 - DNA, 257 bp, Homo sapiens
tgagcaagagtttgtactggaatacaaaatcaatttgatgtccttttgataacacctgggtttgcaagggatgaggaagcaggcactcccatacattgtctgtgggaatgtaaattagtggaactgttgctagtctagcaggattacaagtgtacatagcctgttgacccagcaaaattctgcttctagggattgactatacccactgtaaagagacaggtgtataacctagggtcagaggtctcagtgtttctctt

SEQ ID NO: 46794 - DNA, 173 bp, Homo sapiens
tgggagtcgaccacatgagcctgctcagctctgcataagtgcttcaagacattgggaggcttcacttaaacacagtgtgcaaattggcagctagaggtttttcataggcagtatgtttgtaccttaggtgtttacaaatattaaggtacttttggatacaaaatatatctttt

SEQ ID NO: 46795 - DNA, 150 bp, Homo sapiens
ggcatgtgactgctgacaaagatggtgtggccgatgtgtctattgaagattctgtgatctcactctcaggagaccattgcatcattggccgcacactggtggtccatgaaacagcagatgacttgggcaaaggtggaaatgaaggctagt

SEQ ID NO: 46796 - DNA, 154 bp, Homo sapiens
  misc_feature 71, 99: n = A,T,C or G
gaagaagccatgaccgaccaatatgttgacatactgatcctctactctgagtggggctaaatagctatctngtctgaccgcctactggaaatatttttnaagtgggaccaaaataggcatccttaccaaatcagggaggcctaccttgacaacg

SEQ ID NO: 46797 - DNA, 207 bp, Homo sapiens
  misc_feature 61: n = A,T,C or G
gctgtgcttgttggtttgaccatgactgtattgctttataaatgtacaaatagttactganatgacgagacccttgtctgcacagcattaataagaaccttgataaggaccatattctgttgacagccggctcacagtttcttgccttaagcttggtgtaccctccagtgaggcacaagatctctctttttccaaagttgagaccag

SEQ ID NO: 46798 - DNA, 164 bp, Homo sapiens
  misc_feature 85, 98, 146: n = A,T,C or G
acagaaagctgaaggtgctggagatgccaagtgaagtgtgtgcatttttgataactgtgtacttctggtgactgtacagtttganatactatttttgnatcaagttttataaaaatgcagaattttgttttacttttcgatttttnaaaagctatgttgttagc

SEQ ID NO: 46799 - DNA, 239 bp, Homo sapiens
agaaccaaagaatttgacaactcacaagctgaaagaaacttcgaggaagacgctactcagtcttagagattgagctaataatgtttgtaaattgtcttttggtctgcttcagattaaatgtgttttgaattctattaatgtctatacattggtcacctaaatactcatattctcgagttttatacagttgtatcacatcgaaaagtgtctttactgttttctgtgtggccatcatgttt

SEQ ID NO: 46800 - DNA, 243 bp, Homo sapiens
gtttagctacggcaatcctgaacttcctgaagatgtccttgatgtgcagctggcattccttcgacttctctccagccgagcttcccagaacatcacatatcactgcaaaaatagcattgcatacatggatcaggccagtggaatgtaaagtaggccctgaagctgatggggtcaaatgaaggtgaattcaaggctgaaggaaatagcaaattcacctacacagttcttgaggatggttgcacg

SEQ ID NO: 46801 - DNA, 164 bp, Homo sapiens
ttgctagactcagaaaaaatactactctcataaatgggtgggagtattttggtgacaacctacttttgcttggctgagtgaaggaatgatattcatatacttcacttattactttggacaatttagctagggccttttcatataacagggcatgatgctgaggt

SEQ ID NO: 46802 - DNA, 170 bp, Homo sapiens
tctctacaacctctctcctcagcgcttcttctttcttggtttgatcctggactgctgtcatggcgtgccctctcgagaaggcctcgatgtgatggtgtcccaccttcccaccaggtactcggggccaagaggggtgaccaggttcaaggctccaccaaggtcaggcacct

SEQ ID NO: 46803 - DNA, 303 bp, Homo sapiens
tttgctgaggctgtaactgagagaaagattctggggctgtgttatgaaaatatagacattctcacataaggccagttcatcaccatttcctcctttacctttcagtgcagtttcttttcacacttaggctgttggttcaaacttttgggagcacggactttcagttctctgggaagtggtcagcgcatcctgcagggcttttcctcctctgtcttttggggaaccacgggctcttctcaggggctctagggactgccaagctcttttcgccagggagggcccaaatcaagagtgagattttga

SEQ ID NO: 46804 - DNA, 392 bp, Homo sapiens
tccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtggtcgcttgttggaggtttgctttatttgagaaggaacaacttggagttcatctataacaagactggttggggccatggtgtctctgtgtatagtctttgctatgacttctggccagatgtggaaccatatccgtggacctccatatgctcataaggacccacacaatggacaagtgagctacattcatggggggcagccagctcagtttgtggcagaatcacacattattcy

SEQ ID NO: 46805 - DNA, 224 bp, Homo sapiens
ttaagatgtctgtactctatatgtgatgctgtgcagtttgtttttatatggaaagatgtcaactatagccataaccaataaaataaaaactgatgaggcatgcagctttcagcacatcttttatacatgaggaaattaattttgtgttgctatggtgtttgaaatatccaagatgttctgtatctatgtaaacatgattcctttaataaatggtatttgactga

SEQ ID NO: 46806 - DNA, 279 bp, Homo sapiens
ggctactctcaaactcctgacctcaggtgatctgcccacctcggcttcccaaagtgctggaattacaggcctgagcaccccacccgcctattttcttaaaggggaacaaatgatcttgacaacatattattccataaaaccagtttagggcacaggccagttcctgattagaacacaggacctctgggagggactatcagagatagcaaaaattacttccaagattgagtttattgttttcatatgtatcgcaaaagttagaagtcattttacaaatta

SEQ ID NO: 46807 - DNA, 255 bp, Homo sapiens
ggttgaactggggtgaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgttaccctcttctaccagcctgtgggaccaaagcagtatccttacaataatctgtacctcggacgaggggggtgatccctccaaagaaccagagcgggtggt

SEQ ID NO: 46808 - DNA, 148 bp, Homo sapiens
ccttacagttcctgcttggtcccacccactgaagtagctcatcgtagtgcgggccgtattagaagcagtggggtacgttagactcagatggaaaagtattctaggtcccagtgttaggctgccagttttacaaactaatgaggcaatt

SEQ ID NO: 46809 - DNA, 207 bp, Homo sapiens
cctccgcactttgttctattgtgctcggaatatctctctgtgctgtccttcctcaccagcctgtggactatggcctacatgtcttgacccgcattggagtcactttatgagccattccggcctttctgaggggctatcatccctttctatattactaattaatttcctagagattttgtgcttttcgagagagtatatagatgtccc

SEQ ID NO: 46810 - DNA, 291 bp, Homo sapiens
aaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaatagttgttttccagttattcaaagcagctttctatatgtagaggtgcaaattattaagttgtttccaatacaataagaaaaagcatctgttttccacttt

SEQ ID NO: 46811 - DNA, 257 bp, Homo sapiens
atgctagaggtgaatatttgggtcatttacatgtacactacatagcaagttgatactcatgttgcatgttcttttaaattagtgattttctgtcttaaggctttaacttccaatacttcatcatgtatgtaaccttccatgtttgcttctgataaatggaatgtaggggtcactgcccacttcatgagatatctctgctcacgcttccacgatgttctcaatgacattagccaaagaggggggtcccattcatcccc

SEQ ID NO: 46812 - DNA, 208 bp, Homo sapiens
gtattcaataccgctcagtattttaaatgaagtgattcttagatttgttttggatcaataggaaagcatatttcaggccaccaagatgcaaatgtttttgaaatttatatataccccaaatttttaagtgagggagagagacccccaacacattttttcttttaactttaagtgtcttgccccccaatacactagggacacgcatgag

SEQ ID NO: 46813 - DNA, 211 bp, Homo sapiens
cagacatgtacatcaataacctgagggcaagggtagttgggaaaccctgtgttgtcgggacattgaacccagagagggaccatttggattggctaagagagagatatatctcttgagactctttcacactctcacacgcgcgtagggaccccccaaccacatcacagatgtgtgtcacacatttttataggggaatatgagatatatatga

SEQ ID NO: 46814 - DNA, 222 bp, Homo sapiens
tgatatggctgatcattctaatttgatccaaggttgcttgtcggagctgaggatgcttgtctgatgagggacatgaaaacaatgaagagtcgttatatgggaccctatgaccctaatagagactttctaaatgggcaaaaaattcgctgtaacaaacacaaaaagctttttggggaccccacagcggtaaataaagcactttaaagagcaggagggtcttct

SEQ ID NO: 46815 - DNA, 137 bp, Homo sapiens
agctgttaatgtaaacctgagggtaataacactactcttttatctacctggaatacttttctgcataaaatttatctttgtaaggtaaccctatttatcaggggttcttctaggccctgcaacccacttcagagtag

SEQ ID NO: 46816 - DNA, 193 bp, Homo sapiens
ctacggtgaacactataatttacaaactgaatagttgacccttgactaacttaatacttggtgtgtttaaaaaggtcttgaaggatggtgttagtgcccctttcaagctttcttaaaaaaggaaaacccaaactcgggggagaaaaggggttttattgagaaaaattccaagggtgggggggcccccaatttt

SEQ ID NO: 46817 - DNA, 137 bp, Homo sapiens
cctggagctttcctgatgatgctggccctacagtacccccatgaggggattcccttccttctgttgctggtggtactcttaggacttcaaaagtgttgtcttggggtttttttattaaaagaaaaaaaattttcttw

SEQ ID NO: 46818 - DNA, 159 bp, Homo sapiens
tgcctgcacaaacaccctccctcacacacaactccccctacatcccacaatacacaggggcaaacacaacaaaatttttttggagcacagcacttctcatttttaaaccacatacgggcccccagtacgattacaacgggggcgccgggagtgaggggg

SEQ ID NO: 46819 - DNA, 230 bp, Homo sapiens
tcagactccagcagccaagatggtgaagcagatcgagagcaagacttctttttcaggaagccttggacgctgcaggtgataaacttgtagtagttgacttctcagccacgtggtgttggccttaaaaaatgataaagcctttctttaaattccctctttaaaaagatttcaacgtgattttcttgaagttgatgtggatgactctcaggatgtttgttcagagtgtgaag

SEQ ID NO: 46820 - DNA, 198 bp, Homo sapiens
ctgcaagtaacttcaaaagggtgggggaagggcgatcttggcatgtgtcggagaaatgaaaacattttgtggagagcatttatgactgtctttacaggaaaaaagcaatcaaaatatgagcaagagtttcttttgttcagggttcacacacatttccccccgtgtgttccccaaactcttctgtgcgcccagtgttct

SEQ ID NO: 46821 - DNA, 233 bp, Homo sapiens
ttgcaattactatctcatttattcttgcttttatttctttctctggttctctccctcttttttaatcaaggtcttaaggcttcttttctgtggcaaaaaccagagaaaggtacacactgtgagggggtatcatacccttaaaaacggggcccatatagggagagtttaatatttaaattcaaatggggggctctcccccgagaaaaatctctgtgctctagactctatattat

SEQ ID NO: 46822 - DNA, 240 bp, Homo sapiens
tctcggaagccggtagcgcttgcagcatggctgaccaactgacttagagcagattgcagaattcaaaggagctttttcactatttgacaaaggtggtgaatgggaactatatacacacacaagggatttgggaactcttaaatgagagtctctcttgggcagagatcccacaaagaggagagattacaaagccacatttttaatgtagtagagttttcgtagggaatggcacacatttct

SEQ ID NO: 46823 - DNA, 251 bp, Homo sapiens
ctatcagttcttgctattctcagagcactctatcatgtttttaggggtatattgtgtattcagggtagcattaaaaagaactgatggcaaatgtattgactcacagtgggaacaatcgtttgggtgaagaattagtggtttagcccttgaaatgaataccctgaatcaatcttctgattttctagtagtgtattatctcaaaagattattatcccccccaaaaaaactcgtctgtactctggggtggtggg

SEQ ID NO: 46824 - DNA, 257 bp, Homo sapiens
ctctaggagctgagttgctggtttggaagtgtggagattgcatttctggcttctctcaatggcttgtgttgaggactctgggggctcctggccctaattgtgcaccctgatccccgtgcttggagctaggcctggtggcgtgctctagccctctcagttaccagctctttggagaaggatcaaaattcagatggattgtggggtggggaataggggagagtagaaacccttccctccaggaggccccccctgtcttc

SEQ ID NO: 46825 - DNA, 235 bp, Homo sapiens
cattcatattttccatcttattcccaattaaaagtatgcagattatttgccaaatcttcttcagattcagcatttgttctttgccagtctcattttcatcttcttccatggttccacagaagctttgtttcttgggcaagcagaaaaattaaattgtacccattttgtatatgtgagatgtttaaataaattgtgaaaaaaatgaaataaagcatgtttggttttccacaggagg

SEQ ID NO: 46826 - DNA, 380 bp, Homo sapiens
ccctcataaatagattaatgttgttatgaaaagggtgtgaatcactggattcatccccttctctccttctcattgtgagggtacagtgtttgttctctcttgccctcctgccttctactatgtgaggatgcaacgagaaggcccacacaggtgccagtaccttgatcttggactttgtagcctccagaactgtgagaaaatgaatttcttctttttataaattgccaagtctgctatagcagcacaaatggacgagggcattgtgcttcagtctgattaacgatctttaaaattgtgtagatatctcaacatgatgcagcttgtccattgcacttttgaagatactttctctcaacacttgtttttgagctggggcaccc

SEQ ID NO: 46827 - DNA, 321 bp, Homo sapiens
ctgcgcagggagagccccaggtccagttcaaacttgtattggttggtgatggtggtactggaaaaacgaccttcgtgaaacgtcatttgactggtgaatttgagaagaagtatgtggccaccttgggtgttgaggttcatcccctagtgttccacaccaacagaggacctattaagttcaatgtatgggacacagcgggccaagagaaattcggtggactgagagatggctattatatccaagcccagtgtgccatcataatgtttgatgtaacaccgggggttacttacaagagtgtttctaactcggcatagagttctg

SEQ ID NO: 46828 - DNA, 207 bp, Homo sapiens
caattaataaattttacttcttccttcacatttcttcttttttcagggaaaatttttttaaaagggggcctttttctaaaaaaacaaccttttttcccccaaaacccacactctttaatgggggggcgatgaatggtccttcaacttgaaaaatttgtaaaagcaccccgggacaaggaaaggaaccccccacctcccgtctttcta

SEQ ID NO: 46829 - DNA, 232 bp, Homo sapiens
ccagggcaccagatggggctccatggccctaggaatccccagccactttgggaaggccccagggtagaagggatccaccttggaggccccagggaattttggaggacccacgcccccgggcaaacaaaaagggggaggacccctctgtcctcctaccaggagaattattcaaaaccaggccccacggtatttggtggggacaactttcccctttggggttccccgcattcct

SEQ ID NO: 46830 - DNA, 440 bp, Homo sapiens
caacagcgccaaggaagctctggtctggaaagtgctggggaagttaggaatgcagcctggacgtcagcacagcatctttggagatccggagaagatcgtcacagaaagagtttgtgcgcagagggtaccctatttataaacccgtggccccctagcagtcccgtggagtatgtggtcttctctggggcccccgcacacccggggtctcgcacactctaagttatatatattgtgtcgcaaggttctcgatcccctcctctcttaagtacgtcgccttataatgattactgggtttccgccgatgctgcagaggttggtgtttatcctcatttcaggtgctgggggttctcccccccttaagtagatctgcggcgcccaaaagggtttaagagggcctacacgcccccgagggggtagctccttgcccctagagtgaaatc

SEQ ID NO: 46831 - DNA, 149 bp, Homo sapiens
atgaacgcaaggctgtgatatggaaccagaaggctgtctgaacttttgaaaccttgtgtgggattgatggtggtgccgaggcatgaaaggctagtatgagcgagaaaaggagagagcgcgttcagagactttgtggtgcataattgata

SEQ ID NO: 46832 - DNA, 200 bp, Homo sapiens
gctgtgtctttcttttcaaccgcacggtcttgtcccaatatggcttaatagtttcgcccattttttccggaataccgcaaaatattggggggagtaaattggctaaatcgctctcctaaaaaatataccggcgatatgcgtcactgaaacccattttgggctctgtatataaaatacacgtttcgcgacccaagataaaa

SEQ ID NO: 46833 - DNA, 365 bp, Homo sapiens
cctcaggctactcgtgttgggattgctgtgtcccacccaacctcttctaagttgtggctcccttgtttctccctgatgtgggaggccccataggaagttttacttctgggggcatttcctccgcctgttcttatagtggtgtgaggtctcttgtgatctggtggtttttgggggggcaccctatcgctcaggtctcttctctctgtctgcgccgtgtgtgtgtgccttccctcctctgtgttgtgggcctctcgcgcgtggactgtgggcattcgcctctatttttgtgaatccctgtcgtgggtaaaaaatcggagaaaaaaacgggtatgcgctgggcgtggtctcccctgccggttctgtgg

SEQ ID NO: 46834 - DNA, 213 bp, Homo sapiens
ctgggactaagcaaaggatccttgccttgaggtgtgaggtgctgtatccgggaaatctatctggaccctggcctcaagtccaggaggatgacagagttaggagggcccaccacaaagaattttgggcccaagaacttttttccccaggagccattccttgaggcaggattagccgggtgtgtattatgtatatttgtgtgggactctctaacc

SEQ ID NO: 46835 - DNA, 151 bp, Homo sapiens
actaatactacatttcagtgtaatcatcttggggtggtttggccaagatttcccaattccttgatatctggagtttcttcaccattgtcccgcatccttcggaggcttaatatacaagcggaagggcaacaacaatttgtctctatatagg

SEQ ID NO: 46836 - DNA, 141 bp, Homo sapiens
cttaaggattagaaaacttgttccatttattactattccacaatctatcatgtaatccagttatgtcagaaattcaccctctgtctgttaaactgacgagccacaggacaactctgtctcaaatgtttgtctggaaggctt

SEQ ID NO: 46837 - DNA, 123 bp, Homo sapiens
attcccttgccaggcggcctttggatctctcttccaagcctttcctgacttcctcttagatcatagattggacctggttttgtttttcccgcagctgatgacttgttgcccccaagtgacaat

SEQ ID NO: 46838 - DNA, 118 bp, Homo sapiens
gcacatcacgccggcgtttcggttattggtttggtccaaacaaataaccagtgtacaaaaggggggacaatagggaacaatctaggggaaacagcattttggccccacccggtttata

SEQ ID NO: 46839 - DNA, 180 bp, Homo sapiens
tgttactgtgctttgtttgaaagtagttttctctctcaaaggcgttgcttatatcgttaagaatgaaggtttgtgtttaaaatttattgcattgcaaaggggtagtttcactgtaagtcatgcacccttaaataagatgaaatatttgtatttattgtcccacttcctcaagccgtaact

SEQ ID NO: 46840 - DNA, 151 bp, Homo sapiens
ctcaatagctacatgtacctagtggctactgtattagacagtacagatttaaagtatctattgttgagggtgacagaagggaggagctgtttttacctaccccattctgggatgtaggtctcacattatagcctaacatttcagtaggagg

SEQ ID NO: 46841 - DNA, 133 bp, Homo sapiens
accagtgcaagtgaccgacaaaatttcagttatttatttccaaaatgtttgggaaacaggtataattttgacaaaagaaaaatgatacttctttttttttttgctgttttcacccaaatacaattcaaatgtc

SEQ ID NO: 46842 - DNA, 143 bp, Homo sapiens
tccaaggagaaaataacccgagagaaaggagttcaaaggttaagggacttaggtttaatgtgaatttaaccacaaggggtgtacagacgcgccctgctttttacacattgtttttttgtggacctagagagatataaacacat

SEQ ID NO: 46843 - DNA, 209 bp, Homo sapiens
ctgagcactcaggcaatcacactctcagaactgcggccgcccttggcttcaagcctcccagggttcctggccaaaaaaggaggcgctttcacacaatgcttcacatagagcccgggtgggttctctttggtctccccactatttcacacacagagacatatatttgccccatatagcgaaatatagggatcataacagagcctgcgtcg

SEQ ID NO: 46844 - DNA, 210 bp, Homo sapiens
aggagagagaaaggagagacaattatgtttctgaggtctcagccttggatcaagaggattatttgaagggaggtcccgacaataaaggggaattctgaagctttttttgacttttgggcagtgcttttctcacaccctccaggggcactctagacctcccagagtgggggtgtgattttctaaaacgcctcgcgggacctcttttgtaat

SEQ ID NO: 46845 - DNA, 169 bp, Homo sapiens
gactttccaacatttttgttattggcaagggcaacaaccatggatttctcttccccgaggaaagggtatccgcctcacccatatgctgtaagaggagagaacaaaaagagctgtgcgcgcccaaaacaaaagacaggtgtggggaaaatttgggcgcccccgggggtam

SEQ ID NO: 46846 - DNA, 300 bp, Homo sapiens
aaacattctgactgtgaggtaataactgatcttactgtagttgtcatttctgttgaatgagtaatatataatatagaattctttttatagtctatatgtctataatggtgatggattagatcttggattagaagaacatataggtaaatgatttgtatacctttgtaaatacccttctattaaagataattgctaattaatgattagtgagttactaaaccttttattgagatatactgtgcagcctgatgcagtgctcatacttgtaatctcagcactttgggaggctgaggcaaggag

SEQ ID NO: 46847 - DNA, 490 bp, Homo sapiens
attaggcaggacgaaaatattttttgggttgcagacttgaaaggaagaagtaaaggtttttctactgacagataacacaggcttggttggacgccatcctaaggaattcactaaaaaactattagaactaacaatacaggtcaggagggttgcaggatacgagaccatgtataaagatcaataggatttctatacactctcaatgagcaatccaaaaagactaaataagggggaagacatcccatggttatgggtcataaaacaatatttttaaggatggggtactgcctaaattatcaacaggattaaatggaactctatccaaatccgggtagcctcctttttggcagaaggggctagctgacccaaaatcataccaaaaggccagggacccaaaatagctaaacaatatgggaaaagaataataacctagagggatcacacttccctatttaaaactactacaaagccccgagcaagacagggggga

SEQ ID NO: 46848 - DNA, 443 bp, Homo sapiens
ctaaaagcttccatgaaggggctggtaacctgacttggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatggccgagcggagcggccccacctccagaaagtatttgataggtacaagagttacagcccttatgacatgttggaaagcatcaaggaaagaggttaaaggagactggaaaatgctttcctgaacctggttca

SEQ ID NO: 46849 - DNA, 414 bp, Homo sapiens
ccatgttttcttcccttatcttactgtcattggcctagaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgcagcatgttgttgttgaagtgtggagttgtaactctgcgtggactatggacagcaacaatatgtacttaaaagttgcactatgcaaaacgggtgtattatccaggactcgtacactattttttgtactgctggcccgtaccagaaacatttcttttatggtacttgcttttaaacttggttagcccttaaaatcgcttatggacaattgcctcaaaatcatc

SEQ ID NO: 46850 - DNA, 174 bp, Homo sapiens
aactaagactgaaaataaccacttgtaaacattcctatgattgttactaaaatgtattttcaagtttaaaatgtttttgggtattttttggggtaataactactacaatgaattgcattttggggggccgaaataatatcattaaaagggttttccttttaaaataattgggaa

SEQ ID NO: 46851 - DNA, 135 bp, Homo sapiens
caaatgatctagtcactttcgatactgtacttcagatgcgaaatggatattcgagtggaaacctgacaaagggcgcctccttttggattggaaccggttttagaacaaaaaaccatgggttgggggcagaggggt

SEQ ID NO: 46852 - DNA, 239 bp, Homo sapiens
atctatggtgcagactgccttcgtcgggtgcagactgagcgaccgcagccccagacactacagctggatttcttgatgaaaatcttgccaaattaccaccacctaaagaagactatgaaaggaagctcaactccagtaaaagaactaagaacagtgtataacatgaagataacattttgtctttgaccactgtcttttgaatgggccccagtgtttatgtactctttacaactcacaga

SEQ ID NO: 46853 - DNA, 200 bp, Homo sapiens
tctaacaccactaacttaaccttaagttctttcctagccaaagccaagaacttctgctaagccccagtttttgggctcacttgtcctgcattactaggaggaaagttataaaaaaggaaaatgttttagggtgataaaattcttggggttaaagtgccatgtttccgggcctttaggtgacatttaatgatcaataaatt

SEQ ID NO: 46854 - DNA, 198 bp, Homo sapiens
agtttcctgagggttttctcataaatgagggctgcacattgcctgttctgcttcgaaggattcaatacccctcagtattttaaatgaagggattctaagattttggtttgggtcaatatgggaagcacatttcacgccaaccaaggtgcaaatgtttttggaatgtgtatgtccccaaatttttaggaggggaggcac

SEQ ID NO: 46855 - DNA, 210 bp, Homo sapiens
aacatggtgaaaccctgtctctactaaaaatacaattagccaggtgtggcggcgtaatcccagctggcctgtaatcccagctactttggaggctgaggcaggacctgcttgaacccaaggaggtggaggttccagtaagccgtaatcgcgcccactaggccaagatgcgcgcacacttactctcacagcctggggcgaacagaccacagt

SEQ ID NO: 46856 - DNA, 107 bp, Homo sapiens
ctgaggcaggagaatcacttgaagccaggaggcggaggatgcagttagccgagatgatgccattgaactccatccagtcttgggtgaaaagagcgaaactccgcttg

SEQ ID NO: 46857 - DNA, 300 bp, Homo sapiens
ccaagagaaaataagaatagacccttattaatagtgctgttgttccagaactaaaacacaacccacaatttctatgaaaccaacccttttgtttgcttagaagttgttggtccytcaaggagggcagaaagtagggagatgggggccatagtgttatattgatctctttgagcagcaaaaggttgtatatattgggagggttgtgatcaccactcgcaaactcgtgagagtcatatatttacacatacacagggtctcgggtatgggcaaatttcacaacagactcttggtggttctcgt

SEQ ID NO: 46858 - DNA, 215 bp, Homo sapiens
atgtttaaaggtttaaataatcagaatttataaagcatccagcattttcattgctaaaggaattttgctgtcaggcaagtttttaaaaaataagtccagttattttattctttagaaatcttcttccattttaacagccctctaggctacaacccaaaacaaatgtgctcaaggaaatgttggaaggggtaagatgtttgtgggcacacatccca

SEQ ID NO: 46859 - DNA, 157 bp, Homo sapiens
taaaaatgcttggcaaaaaaaatatagtgttaaataggccagtgatattaatgagaaaatgaaagtatgtatcaggaataaagtgatattgcataggagtattgtattttcatgaatttatgccagttgttacatgacctatatatgttaactaaaa

SEQ ID NO: 46860 - DNA, 209 bp, Homo sapiens
tgatgccagagaagatgaaatggaagagaacctgactcaagtgggcagtatcctgggaaatctaaaagaaatggccctaacaaagggaataagattaatgttaaaaatccacaattaaaccgattaacagccaaggttgaaaccaccagaggttggtaattgtattgccattgccagagcaaggagactcattgacagctaaggctact

SEQ ID NO: 46861 - DNA, 220 bp, Homo sapiens
tctctagtttaataaaaatcatggaaagactcttaatgcagactcttcttaagtgttaataggggatttttttcaagcttatttttggttccaggtttccaatttttaaaaatgttgagggaatctttcccaccttcccaaacctaattcttgtaaggtggattatgggttgccccaatcctttctcatggctcaattctttttatatccattcttttca

SEQ ID NO: 46862 - DNA, 222 bp, Homo sapiens
tgcacctctcctcaggaccagctgttgctatttcggattaaggctttaaccatatcttagggcaagaactcatcaacctcagcagttgagttgcttggaaatgcccagggtccacacaagttccccaggggaacccaccatgggtttggggactggagtcatgggacaaaaaggggaatggtagaggcagggaacagaaacaggggacggaaacaacagatt

SEQ ID NO: 46863 - DNA, 173 bp, Homo sapiens
ctttgagtgtaccagcttatggtggccattgatgagggattaaagtaggtcaaaatttaatttggaggttgggtatttactttcggtaaaagcttaggttttcaaagagggaaggaaacccaccactttaccttaattgtttttcttgtattctaataaaaaatactctttca

SEQ ID NO: 46864 - DNA, 240 bp, Homo sapiens
caaatatttattgagtgccttccatgtgtcagggagtcttctaaacatgaggatacagcagagaacaaaacttacatccattccttcccttaaaaaggtatgttttttaggcaagggggtttaacaataaaccctaaaggtaacaccttaaattggcaaaacaagggattacgggcttataaattgagggcaaaaattggaattttaaaaatttttaattcaaacaaaggccaaaattta

SEQ ID NO: 46865 - DNA, 246 bp, Homo sapiens
cagcagaacatcgcttggacgtgccttgcctaaggcattctacccacagcaccatcaaggcacgttgggagcttttctgccagaaacctgatctcttttttgggggtggggagggacatggggggaacccacctacaaccccaacaaggttaaattcggggtctttctttttttaaattggggaggggattttaaaactcggttttttcaacaatggggctttttattggggggcacccctttaca

SEQ ID NO: 46866 - DNA, 110 bp, Homo sapiens
tattggattcttgcatggagggacaaggtgggccagccacactaggggtagcacacgatgtgttaaggaaccgtaaccttaccccatttgtttgaatttaatttgatttt

SEQ ID NO: 46867 - DNA, 357 bp, Homo sapiens
  misc_feature 321: n = A,T,C or G
agaagtggacctcattgggatggtgaggctgacagaaaccaggcagccttttgttcctgagaacaatccagaaagggaccacttgcattatcgagacctgggaagctattgccagaatcacaagcgcagagcccatcttcattgtatgccaactttccagagcacagatccctggaggagccctttgaggggcaaaccagagattcctctttggagcgcgcttatttcagtacatagtgagctcgtatagattctctgtagatacatactttctctggggttagagattctctttgcgcacatcgtgtgttacacatcatncatctgtggcccctcctcgcttaatactgttttttt

SEQ ID NO: 46868 - DNA, 367 bp, Homo sapiens
ctttcttctcttccccttccccacccgaattcttttctgaagttgcttgcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagtgaatgtgtcaggaaaaccaa

SEQ ID NO: 46869 - DNA, 106 bp, Homo sapiens
aagagccagtttgctcagtcaagtgatcagatcccgaatctagattcccagttctaaggccttatcactccctgcccataggccaacaaccattagttcctaacat

SEQ ID NO: 46870 - DNA, 145 bp, Homo sapiens
cgtgaaagcttgcgtaggctctgttgtgactaaagctactttcgaagcagagattaacagaaactttcagatttgggtttggaaaccaaacacttacaggaccaagtttgggcaaccgaatgtaggcgttcattcaagctggagg

SEQ ID NO: 46871 - DNA, 333 bp, Homo sapiens
acatttttaatcctgaataatatctaaaagactaatactgtcaagcttatgtgactaacaaagctctattgtggtttggatctgatgggaatctgtaaagtagacagaaaagtgtgtcaaccatagtagttggggtgtttctcactaaaaaaaaactatgggggagtctctaggttaaaaatactaggtctctcaaatatagagtatctctctttccatatttctctaaaactgtgtttaatttataatggtaataaataaaggttatcaggggggtttttcaatttcaaatttcaaggattgcatcttaatacttgccagtaattgtggtgg

SEQ ID NO: 46872 - DNA, 248 bp, Homo sapiens
aatttgaaatgtcttatgcttttagagttgcaacttaagtatatttggtagggtgagtgtttccactcaaatatgtcacttaaaaaaaataggccctttcataaaaaccaaactctggcaagatgcaaatgcatggcaaatcctgtcggtctccagttggtaatctgaatagtgtcaccaattccaccaaagccagtcctgaagattggaaaaggcaactcatttggattgcctaactcctctggcct

SEQ ID NO: 46873 - DNA, 217 bp, Homo sapiens
aacagtctttgaatatcgaacacgcaaggctgtgagactacctattgtagatattgcaccctatgacattagtggtcctgatcaagaatttggtttggacgttggccctttttgctttttataaaccaaactctatcttaaatcccaacaaaaaaaatttaactccatatgtgttcccctggtctctgatctggtcatccagtgcaggtgaccgcca

SEQ ID NO: 46874 - DNA, 297 bp, Homo sapiens
tgctgagctgcgaggcctgacatcacttaccaggagcctcagggaacccagccagcacagcagcagcagccttgctctatgagatcaaacagtttcttggagggttgcccagaaccagggtgacaaccaagctctgtaaggggtttcaagtaaggttgctgacacaggtgtccgaccttgcacaacgggattggcctcaatgagaggttcaactcgagagatgggaaaatcagctctcatcactcagataatattagtcatataatagagttgatagtgaggtatatagtagtacca

SEQ ID NO: 46875 - DNA, 227 bp, Homo sapiens
gaaaaaggaagaagaacaggagggcaagctccaacatgatgaattaggacttccttattccaacctaaactgtgtttataaaagcaattgcatacacaccaaaaaaaggctattgggtttcaaaggctacaatttaagtaacaagttaatgggcagttgtttaattggggttttacttaactgttgtacttttaaaggggctgtgaataaatgtttatggagtttta

SEQ ID NO: 46876 - DNA, 129 bp, Homo sapiens
aaaaaagagcagcgatttggcaaaagggaccggaccaaccgccgaaaggaagcggaaccaacgcgaaacgaacagcaacaggcggccaggcacacccaaattcaggcaaggggaaaagcacaggcgggc

SEQ ID NO: 46877 - DNA, 279 bp, Homo sapiens
gtgcttcccagattattgaaaaatgttacagacaacttgcctgatttttaaatgagcgtaaaagggcctctaacctatgcaggtttccccattatgcatatagaaaatgctagtatgttttgctcacttcatatgtaacaggtgcccttatgttgtggctgtatcctgtgctttttctgtgggaccattccattcagggacaaagagcaccatgattccaatcttgtgtgtgtttactaacccttccctgagggttgtgtatatcggagatagtggtgt

SEQ ID NO: 46878 - DNA, 131 bp, Homo sapiens
gcagaaaacaaaacagggtaagaagagccggggtgcagctgacagaggaagccgcctaaaatcccttcacaaataatggtgcaaatatatatatggttcagaaggcctctccaatttggcaatgttaaatt

SEQ ID NO: 46879 - DNA, 189 bp, Homo sapiens
ctgtgtgtggcatgtttacagcaggggctgcttcccttgtccactttgcagcctgtttctgtcatgtagtttcaacaagtgctacctttgagtgtaaactaaggtagactactttgggatgagacatgcaaaatcaggaaaggctgtagaaggaaatataccttaacaggctgatttggagttagccag

SEQ ID NO: 46880 - DNA, 332 bp, Homo sapiens
ctttgatacccaggaagaatacagcgagtatatgaacaacaaagagctttgccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacacccagagatgctccacaaggatatgctccccactgttttctttctacaatttccaaaggttgcaagatgtttttttgtggatgaatataaaat

SEQ ID NO: 46881 - DNA, 228 bp, Homo sapiens
tggatcacgaggtcaggagatcgagaccatcttcgctaatgcggtgaaaccccgtctctcctaaaaatacaaaaaaaataggccaagcgtgggtggtgggcacctgtagtcccagctactcaggaggctgaggcaggagaatggcgttaactcagaaggtggagctttcagtgagctgagatcgtgccactgcactccagcctgggcgacagagccagactctctccg

SEQ ID NO: 46882 - DNA, 222 bp, Homo sapiens
taggtattaatactatccccatctaacaaatgatgaaacaggcattgagaggttaaacacccctttcaaggagaaggaaatctgaacccaagtagtacagctccagaaaaaagatctttcagtctacacccgactcataaaagtcttcactggaaactcatcaaataagaattatttattgcaataatacagcaaattcatgggggactaggtattatttaa

SEQ ID NO: 46883 - DNA, 273 bp, Homo sapiens
gaagcgctttgaagtgaaaagtggaatgcagtagccctctgggcctggggatattgtggttgataactgtgccatctgcaggaaccacattatggatctttgcatagaatgtcagctaaccaggcgtccgctacttcagaagagtgtactgtcgcatggggagtctgtaaccatgcttttcacttccactgcatctctcggtggctcaaaaaaggacaggtgtttttcattggcaaaagagagtggaatattccaaagtataggcactaggaa

SEQ ID NO: 46884 - DNA, 362 bp, Homo sapiens
aaatatcagaaaaaattggaggttttaaccaaagaattttatagtctccaagcctcttctgaaaaacgcattactgaacttcaagcacagaaactcagagcatcaagcaaggctagacatttatgagaaactggaaaaagagcttgatgaaataataatgcaaactgcagaaattgaaatgaagatgaggctgaagggttcttttttcctacggctatggtgctaatgtcccacacagccaaaagacgacttaaggcaagtgttcacttggcaagagaggtgcttcacttagaaaacaacactcgctgattttgaaagatctgggccaatcgaaaggaccaggtaacacagctttcacaaaa

SEQ ID NO: 46885 - DNA, 275 bp, Homo sapiens
tctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtggatgtggtttgccctattttctgtatgtctccatctattgatgagggtctt

SEQ ID NO: 46886 - DNA, 350 bp, Homo sapiens
tgctgtgtaccctgcctttgaagcacctcctcagtacgttttgccaacctatgaaatggccgtgaaaatgcctgaaaaaagaaccaccaccttcttacttacctgcctgaagaagttctgcctttgaaaataaatcctataccagctttttgtttgtttatgttacagaatgctgcaattcagggctcttcaaacttgtttgatataaaaggtgttgtcttttgtttaagcatttattttcaaacactgaggagctttttgacatctgtaaaacggctttcggttttgtggtaagccttttacattttgatagttgtggagacaaactagggtaaggcagggcaagtgcc

SEQ ID NO: 46887 - DNA, 262 bp, Homo sapiens
cgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcaaagaacacacacatatacacgaatagacatcaaactcaatgctttatttgtaaattaggtgtttttctaty

SEQ ID NO: 46888 - DNA, 364 bp, Homo sapiens
tattgacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggagaatcaacgggacctgttttttaaggagcgagaggagtttgaggcgtttgtttcgcccattggattgttctttttgcgaacaacttttgggatgagaaccccctatgaagttggggtccacctgagtgtatca

SEQ ID NO: 46889 - DNA, 221 bp, Homo sapiens
gggttggggggaaccttccacccttgggggttccccctttttaagcccttttttccttcttggccctttggctttgctttggggactttccaaacggggaatttccgggaaaaaagggccttgggccgggtttaaaagccttggggaaaaggggaccttcccggggaaaagggccccaaagaaacaaaaagggccgggtttttcccccgctttcggccgga

SEQ ID NO: 46890 - DNA, 260 bp, Homo sapiens
gtattttaaatgaagtgattctaagatttggtttgggatcaataggaaagcatatgcaggccaacccaagatgcaaatgttttggaaatgatatgcccaaatttttaggtggggaagtcaccaaaccactcctgctttaactaaaggtgtctggcccgcaatccctgtgggaccacgcatcgatctcgtcactgtgatattttaaatatccacagtactcacttttcccacttgatccgggtaattgcctagagatatct

SEQ ID NO: 46891 - DNA, 167 bp, Homo sapiens
tgaatttaagttgttggtgacatctgcatcatttcataggattagaacttactcaaaaataatgtaaatctttaaaaaatataaattagaatgccaggtggggaatcataaattaaacgttaatggtttctaatgctctctttaaaatatagaaatatcatgttaaa

SEQ ID NO: 46892 - DNA, 152 bp, Homo sapiens
tcacctgaggtcaggagttcgagaccagcctggtcaacattgtgaaaccctgtctgtactaacaatactaaaatcagagggttgcttgcagtgagccaagatcataccattgcactccagccttgggcaccagagcgggcctttttcccaaa

SEQ ID NO: 46893 - DNA, 240 bp, Homo sapiens
tcagaatatttattttacttacaatcctcaagttttaattgattttaaatattttccaatacaacagtttagggtttaaggtgaccaatgacaattaccacctttgcaggaaggaaacttattgaataaataaaactcccttttccctcaatttatttcagtgtaatgaaaaaggtgcttagtatttatgtgggaatttctcctctcccgcacagagggcaaagagaggggtgtatatag

SEQ ID NO: 46894 - DNA, 187 bp, Homo sapiens
aatgagccttaaaaggccacacagcacagtggttaagagggcggggccttgggttagactgacatcatctgaatcccgcttaagtcaggcttcccttaagggaggtggccctcttagtcatatggagagccctggcacagtggggtcccactctacccatttccccattgtcccgacaggggagagt

SEQ ID NO: 46895 - DNA, 143 bp, Homo sapiens
tcaagtttactcatttctatggttgcaaataactctaaaacttattatataaactttcatattataggcaggacacaatggctaaatatctgttgcatgtactttaaaggttattatataaatatataacagagtatatatac

SEQ ID NO: 46896 - DNA, 201 bp, Homo sapiens
cattggtggtcctgatcaagaatttggtgtggacgttggccctgtttgctttttataaaccaaactctatcttaaatcccaacaaaaaaaaaaatttaactccatatgtgttccccttgttctaaacttgtaaaccagtccaagtgacccacaaaattccggttaattattttcccaaaaattttgggacagggtatattt

SEQ ID NO: 46897 - DNA, 203 bp, Homo sapiens
aactttggctaaaaacaagaaagaaatggcaaaagatgtgatttaagagcatggtccttcagaaaaggcaataaacgggcccaactagtgtcttctttggcgatttacaattctaaagctacaaacgtgactctcacggggggagagaaagattttatatccttaaaagaggggaaacactcaaagagagcagcactgcccta

SEQ ID NO: 46898 - DNA, 171 bp, Homo sapiens
gcatcaaggaccaatcactggcatccattgtcatgcagctgttggagcagtagacttctcacaactttttgtcacttcatcggttgacttgggcaaataaaggttttggcaaactaaggaaaacaaaggccttgtattcatttggagataatgcagactctgtttatgttg

SEQ ID NO: 46899 - DNA, 260 bp, Homo sapiens
ctgagtggttgtgtggtcgcgtctcggaaaccggtagcgctttcagcatggctgaccaacttacttaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgaca

SEQ ID NO: 46900 - DNA, 248 bp, Homo sapiens
aaaccagactttgatgactgggagagcgggctgaatgcaatggagtgtgcattacatttggaaaaaaatgtgaatcagtcactacttgaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatcttgcttggcggaatatct

SEQ ID NO: 46901 - DNA, 245 bp, Homo sapiens
aaacgaaaagcagagtcagctactgagagctctggaaagaaggatgtcaagaaggtgaaatcctaaagcctagaaataaagttttaaatggggaactgctattttcttgttcccatcttcaaatgctaattgccagttcccgtgtattcatggtactctaagaaaaatctctttgggtttgatttcttgcatattttatatattccccaatgctttctacctcaaatgtgtagctttatatttta

SEQ ID NO: 46902 - DNA, 243 bp, Homo sapiens
tttcgatttttgatcaattctttaattttggaagcctttaatacagttttctattcttggagataaaaattaaatggatcactgatattttaggcaatctgcttctcatctaaatatttccatattctgtattaggagaaaattaccctcccagcaccagcccccctctcaaacccccaacccaaaaccaaggattttgggattaggctccyttaggttcagagtgtggattgtataacccct

SEQ ID NO: 46903 - DNA, 176 bp, Homo sapiens
tgaccttgctgcctggggcctgctctctcccaggaattctcatgtgggattacccttgccagggccggccttttggatctttcttcccaggcctttccttgactttctcttagatcataggattggaccttggtttgatttttctgcagctgtatgacttgttgccctttaaggac

SEQ ID NO: 46904 - DNA, 111 bp, Homo sapiens
tctgggtttcatccatccgacattgaagttgacttactgaagaatgggagagagaattgaaaaagtggggcattcaaacttgtctttcagccaaggaacttggctttctat

SEQ ID NO: 46905 - DNA, 241 bp, Homo sapiens
tttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattaggttctgatttctttttaacaaatgttatcatgattaaggaaatttccagcactttaatggccaattaactcag

SEQ ID NO: 46906 - DNA, 260 bp, Homo sapiens
tgatgaatttggctagtgatgctccttctctagggatccttcttaaggcagaaaagtggatattatctctgttaaaagggaaggaaattgaaggctcggctaattaaggtgcctaccgtctctacaccagtatgcagaggaggacacaactcaggtcgtctgttccagggcctgggctctttagcacagagccctcctatggctctttttggtgaggttagatttcagagagcccttaaagccaggcagacaaatttatt

SEQ ID NO: 46907 - DNA, 114 bp, Homo sapiens
caagagaaaaatccactcctccaaagaaacgaattaacaggagaagcaagcaggcgaaatgataataggcgggcgccgccaaaaatcaccttccaattcacaagaaattccctt

SEQ ID NO: 46908 - DNA, 272 bp, Homo sapiens
ggactatatccagcctgcaacttgcactgatgcagaatccgtcagatgtgggccgaattttgaattgggaaaacaaaggtgacaggttacaccaacattggttgattttaaattggcttcttacagcacattttttaaggtaaccaatatggaatgcccttactccaggaaaaggccctttcttggttactttgggtttatgggaggcaacctttatggcctgtccaaatttgggaaaggtggcactgtcaaatttcacatttggggccatt

SEQ ID NO: 46909 - DNA, 201 bp, Homo sapiens
attgcgtcttagcagtgatttttatccaatcttgttttccaaaaacccatgtttcccagggccttaaaaggccatcatgtaaattaccagtaaagtgtaacatatgcaaccataccagagtcacttccttggtgcggggtgctccacccatatggatatgagtcatagaggacctagaggttttatgatatgggggcgggt

SEQ ID NO: 46910 - DNA, 247 bp, Homo sapiens
aaaaattactggtggacgcacagcatgagtctggacggagtagctccaagagctctcactgtgacagcccacctcggtcgcagacaccacacgataccaccagagcttctgaaacagatacccatagcattggagagaaaaacagctcacagtctgaggaagatgatatagaaagaggaaagagttgaaagcatctgaggaaaactcagatgggatatggaatgggacaacgtcggccggaaaatat

SEQ ID NO: 46911 - DNA, 311 bp, Homo sapiens
atgatgttgtaggccctgagggcatggagaaattttgtgagacatttggtgttgacccagaaaacgtagttatgcttgtcctagcttggaaattggatgcacaaaacatggggttattttactctacaggagtggttaaaaggatttactcctctccaattttaagctgacctctcatctctcaccacgcgcatatatacatagaggtctcccacacccttaatacgctgacccctcacacgaggacatgacaacgacgacgctcaccacacagggtgtctgctgtctcagcagcttctgcagacttcttt

SEQ ID NO: 46912 - DNA, 213 bp, Homo sapiens
caaaaaaaggaggcaagttctgaggtcactcttgattgcacccaccctgtagaggaaggaatcatggatgctgccacttttggagcagtttttgcaggaaaggatcaagggtgaccggaagggtctgggacccttggtggagggttggtccccatcgaaagagcgcagagacagggttacacccgtcacatcagagggccctctctcaaaagg

SEQ ID NO: 46913 - DNA, 201 bp, Homo sapiens
gttttagatcagctgggcacttggctgaaacctgtctctaaaaaaaattagcctagccagacgtggtggcctttgcctatagtcccagctacccagggagattgaggtgggagattcacctaaaccctgggtctctctgatcacactgctgcattccagcctgggcgacagagtgagcccctgtctcagagtaaaataaag

SEQ ID NO: 46914 - DNA, 230 bp, Homo sapiens
tgtctccatgtttgatgtatctgagcagtttgcttcacagtagctctaggagggctggcacctaagaggtggggagcagagaattttctaatccaccaccaccatctgtggtcagatttggaacctctaaattctctgaaacaaaaggctggttaaggatagttaggcgtccataggttactctcccattatacatactctgttgagagttgggggggaaaatttagata

SEQ ID NO: 46915 - DNA, 124 bp, Homo sapiens
cacccattccgaccatagtatatcatatcaaagggtgaggattcaattaggcatgtttttgaagggttttttttaagttgtyctttttggaaaaaaggaaaaccaaaaaccaaaaccaaaacgg

SEQ ID NO: 46916 - DNA, 106 bp, Homo sapiens
tttattacttcttctttccaggacctgacagaagtcaggaagagtcctcggttaatgttccaacctaagaacctccatttgttgggaatgtgggatggatgtttcc

SEQ ID NO: 46917 - DNA, 149 bp, Homo sapiens
acagagggggagggtttaaaccccaaacttttcaaagggttaaaccacccccaaaaaacaacctctccccaatttgagggtggggtcccacaaattgaaaaggggccctgcccaaagcaaaagaatttccccctagaggcccctttgat

SEQ ID NO: 46918 - DNA, 330 bp, Homo sapiens
taaaagatctttctcccaatctccttcagtttccaagagaaaataagaatagacccttattaatagtgctgttgtcccagaactaaaacacacccacaattcctatgaaaccatccattttgtttgcttagatgttgtgggtccttcaagaagggcagagagtagggagatggggccatgtgttatttgatcttttgagcagcaagggtggtataatggggaggttgtgatcaccactcgcaactagtgagttcatatcttgccagatacaaagcatcaaggataaggacattttccaaaacagcctttggttgttctggtacaaaaaaa

SEQ ID NO: 46919 - DNA, 246 bp, Homo sapiens
ggcctcacaatggtctctcacagtgtttgcgagtccgaggaaggaaaaaaaaaaatctttatttaagatcctgaaggccggccattatttggccacagactttgaagaaactttgggatgtggggcatcatccgcatctttctctctcctccaaaagacaaaggttggggaatttttgaattttcctagcatcgccttgggctcatcagggaatccgctaaggaggaaaaaagaaaagaaaaaagg

SEQ ID NO: 46920 - DNA, 448 bp, Homo sapiens
ttattggcatggatctacacagatgtttaaagttttaaataatcagaatttataaagcatccagcattttcattgctaaaggaattttgctgtcaggcaagtttttaaaaaataagtccagttattttattctgtagaaatccttcttccattttaacagccttctagtctacaacccaaaacaaatggctcaaggaaatgttggtagggttaagatgtttgtggcacattcccatttgtaatggtaaattctgagcattacttttcactcactaattctggaccagtttccaagagatccagaagaagaatatagctcctcctcctcttcattgaataaggaacaattttaacactcaagagctcctaagtggaaaaaaatataatttgtataagcaaaccctctggcacaatgaaataaaacgagaaacagtaacagaggtaaccc

SEQ ID NO: 46921 - DNA, 166 bp, Homo sapiens
aataaaaccagaagaggagtcttaagaaaaaagggaatgtcatttagggcataaagatctcataagaaagttttatgtaaattatatcttgctggatgcgtaaaacatacattgtgtgcgctagaatagaaatgatttcttttcaataaaaagaaagagggactct

SEQ ID NO: 46922 - DNA, 499 bp, Homo sapiens
  misc_feature 3, 4, 5, 8, 9, 10, 11, 12, 13, 14, 15, 16, 17, 18: n = A,T,C or G
tgnnntgnnnnnnnnnnnaccgggaattcggccattatggccgggagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtcca

SEQ ID NO: 46923 - DNA, 325 bp, Homo sapiens
  misc_feature 3, 4, 5, 8, 9, 10, 11, 12, 13, 14, 15, 16, 17: n = A,T,C or G
tgnnntgnnnnnnnnnnaccgggaattcggccattatggccgggaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaatattttaaaactttttttttcaaaagtcataatgaattactttattaataaacaaagtcttgtatttgagaaaaaaaaaaaaaaaaaaaaaaaaaa

SEQ ID NO: 46924 - DNA, 419 bp, Homo sapiens
cattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaattttcaagacctctgttttttaactgaactttatcattggcattgtgggtctttgaagttgctgggataaattaatataatcaaaaaaaaaaaaaaaaaaaaa

SEQ ID NO: 46925 - DNA, 700 bp, Homo sapiens
gctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaa

SEQ ID NO: 46926 - DNA, 548 bp, Homo sapiens
gaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagtatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcc

SEQ ID NO: 46927 - DNA, 355 bp, Homo sapiens
tcaccgacgagaccagaagtgttatgataaacagtataagaaagctcatttgggcagagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtaagccaatgtttctcttttggccct

SEQ ID NO: 46928 - DNA, 431 bp, Homo sapiens
aaaatgaggtaccgttagtgttcgcgattttaaaggctatagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcg

SEQ ID NO: 46929 - DNA, 176 bp, Homo sapiens
attgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctg

SEQ ID NO: 46930 - DNA, 400 bp, Homo sapiens
aacacgcaaggctgtgagactacctattgtagatatcgcaccctatgacattggcggtcctgatcaagaatttggtgtggacattggccctgtttgctttttataaaccaaactctatctgaaatcccaacaaaaaaaatttaactccatatgtgttcctcttgttctaatcttgtcaaccagtgcaagtgaccggcaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacgtaaaaaaaaaa

SEQ ID NO: 46931 - DNA, 111 bp, Homo sapiens
ttccaccaaatacaattcaaatgctttttgttttatttttttaccaattccaatttcaaaatgtctcaatggtgctataataaataaacttcaacactctttatgataacg

SEQ ID NO: 46932 - DNA, 218 bp, Homo sapiens
acaacatgaaactataaaccatatttaaaagctcatcatgttatattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggca

SEQ ID NO: 46933 - DNA, 401 bp, Homo sapiens
cagaatacacgttcttcttaagtgaacataaaataatctccagaatagatcagatgttaggccacaaaacaaaccttagcaaatgtaagagtattgaaatcatatcaagtgttctttcagatcacagtgggataaaaccagaaatcaataacaggagaaatcttggaaaataaacaaatatgtggaaattaaacaatatgctcctaaacagccctgggtcacagaaaaaattagaatgaaattttaaaatgccttcagacaaagaaaaatggaaacacagcataccaaaacttatgggatgcagcaaaattagcagaaagggggaaatttatagcaataaatgcctatatcaagaaagaagaaatatcatgaataaacaatctaatgttacacctcaggga

SEQ ID NO: 46934 - DNA, 558 bp, Homo sapiens
taaaagcaacatcagcttgaccagtataaaattacaggggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttgggcgcttaattctgtctgatattaatttatcagattgcttttgtgcattggataacaccaccattcacaagttaagaatcttggtatttggatatctgttagatgctctaagaaaatagagatgagcttctttttaaagcttttgatgtggtgtcatagaatagcatgttggagatacaatcagctgctttgttaccttaaaactaggcatttgtaaatattaaaccttaa

SEQ ID NO: 46935 - DNA, 449 bp, Homo sapiens
caactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccat

SEQ ID NO: 46936 - DNA, 518 bp, Homo sapiens
atcttcgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagataggtaagtgggatcgagacatgtaagcagcatcatggaggtttgaagatgccgcatttggattggatgaattccaaattctgcttgcttgctttttaatattgatatgcctatacacttacactttatgcacaaaatgtaggggtataataatg

SEQ ID NO: 46937 - DNA, 176 bp, Homo sapiens
catggatgggaaactgtctacggttctcaacctgatctgttaagtccccatgcctggagaagcctaatgccaactcatcatgtgataattcaatctgtacaatgaattatgaacctgataaagatacaactgaatcaaagaatggcatgattgtcccggcctttgcacccaatgac

SEQ ID NO: 46938 - DNA, 386 bp, Homo sapiens
caatatcaattctctccattttcgtctagcagtggaagaagactgaatatctcgtataccagaaacatgactcttaaagatggtaaaaacaattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaccattgaaaaggggttgtcaaagctggagacaaaagtgaaagcgggagatccctcatggtt

SEQ ID NO: 46939 - DNA, 270 bp, Homo sapiens
ttgagcgtgctcactgacctgcctgttgccccagtgacagctaggatgcgcattctcctgccatcaagagactgagtcaaggggttccttaagccagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatata

SEQ ID NO: 46940 - DNA, 150 bp, Homo sapiens
aagaaatcaacgtggtggttggaattactttggccactgcggtccaggagtaaatgaaatgataactccaaagtggtgaaaagcagaacaaacaaaaaaacacaactgtcagccaaaaatattatacctggggaaaaaaaaaaaaaaaaa

SEQ ID NO: 46941 - DNA, 446 bp, Homo sapiens
agctgacagcattcgggccgagatgtctcgctccgtaggccttagctgtgctcgcgctactctctctttctgacctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaattccaaattctgcttgctg

SEQ ID NO: 46942 - DNA, 156 bp, Homo sapiens
cataactccatatggcttgaacgagcagccggtgtgtaccacagagaagcacggctggcaaatacaagctcacctacgcagaagctaaggcgggtgtgaatttgaaggcggcatctcgcaacttacaagcagctagaggcagccagaaaaattgga

SEQ ID NO: 46943 - DNA, 471 bp, Homo sapiens
atactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatggtggtatattgtacttagaaactgtacctttaatattacattacctttattaaaagtgcattgaacacatcaattttagatgtgctttatgtactggtatcctataataaaacttcagcttctattggg

SEQ ID NO: 46944 - DNA, 321 bp, Homo sapiens
ttcaacctcattcctcgtaaaagatccaagctaagactctcctcagatatttatctgttcatattatattgaccaagatgaaaaaacatgggtctactcataagttacagataggggtgtaaactggctcaccctctacagaggaaatttggcaattattaccaaaagaacagacttcacaccttttgacctagcaattccagcctagggcaccactctaggatatacaagatatttttgccatatgccaaatgccactcctgagggacccagaaaaaagtctaaacaaacaaacaaatgggttggcaataacctcatatt

SEQ ID NO: 46945 - DNA, 447 bp, Homo sapiens
ttccaatcttcgtgttcactttaagaacactcgtgttaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtccggattaacccatacatgagctctccctgccacattgagatgatccttacggaaaaggaacagattgttcctaaaccagaagaggaggttgcccagaag

SEQ ID NO: 46946 - DNA, 383 bp, Homo sapiens
catagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaagccaaaaa

SEQ ID NO: 46947 - DNA, 540 bp, Homo sapiens
cttaacccagtaaaaattgttgaaaatgttaaaggtcagcatgttctaattgggaatctagatatagcttagatttcctattggcttagagtatttgctataacaaatgaagtgcaatgacaattatatattcctactcggcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactaggcctggaataatgccaccagagactgagtggaaatcgccccttttgaaggtgccattcttatgagccaaaagttggtcatttaaaagtcaatttggagggaataacatgtaatataatttg

SEQ ID NO: 46948 - DNA, 532 bp, Homo sapiens
ggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggcctgatcaagaattttggtgtggacgttggcctgttttgcttttataaccaaactctatctgaaatcccaacaaaaaaaattaactccatatgggtccccttggtctaatcttggcaaccagtgca

SEQ ID NO: 46949 - DNA, 423 bp, Homo sapiens
ccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatccct

SEQ ID NO: 46950 - DNA, 452 bp, Homo sapiens
ttaagaaagacttgaccccagccttgaagctttatagtttggggaggttaggtaatatgaaatgttatttaacaaaataagaccatacagttggtttcaattattttcctctgttcattttgtagttcttagtaaggatttttttttttattttcttcctttcatttgatagttttttatttataagatttttgaactgatgaagatgagtttgccttgttgctcctaattacagattaaaaactttcttgatttcccctaccgattaaggcaaaattaaatacttcatctgtacttgctaataaaatactttttgaaaaacacttctaccatagaatttggctcatggctttaggcatatttctcctagaccacaaccttactttagggatctttattgctattgcttggcatataataagggggacaagaaaaggacaaaacttagggat

SEQ ID NO: 46951 - DNA, 508 bp, Homo sapiens
gtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgctttgcagtttattgaaagtagttctatatataacaatgttataagcatttctttagaaatggttgaaaatgcttctaaaatgtgattatcgaccatggtatgcatgatcgt

SEQ ID NO: 46952 - DNA, 110 bp, Homo sapiens
tttgaaaatcataaagatataagtttggtgtggctaaagatggaaacagggctgattcttgattcccaattctcaactctccttttcctatttgaatttctttggtgctg

SEQ ID NO: 46953 - DNA, 470 bp, Homo sapiens
ccgtcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggtctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgacccgt

SEQ ID NO: 46954 - DNA, 494 bp, Homo sapiens
ccgacatgctgcagattgaaggagactgatcgagccgcacttttactggacgggaggctcgacagagaggcccgtcactaggattctcaatgcaagaatccagtaccttgcacatagaagtagcaacccatcccttgcctattttcatcttgctgttttcttttttttaaaaaaatggatgtgacttgttttgaatggtttggattatacttggttttgggggggcataaattcattctgtaggatcttaagaaaaagagcccagaatgttgcttctattattgtgcacaaccattgagaggggtacaagaatgcaggtaattttaacatgtgggatgggccatggtggaaaagactatcggaataactctgcagggacagaatttgaagttggctagcatccatctttctactggaaatattcactcccccctagctatcctggaggagctctcactttaagaataaatggggtgggtccaaaaaaaaaaaaa

SEQ ID NO: 46955 - DNA, 380 bp, Homo sapiens
acgatgcatccgctcgcgcgagaaacagattcgaaagggaggggaagctccacatgtcattttaaagttgctaccagtgtatgcagggaattagaacaaagaagaaacattcagtagaacattttattgcctagttgacaacattgcttgaatgctggtggttcctatccctttgacactacacaattttctaatatggggtaatgctatgtgacaaaacgccctgattcctagtgccaaaggttcaacttaatgtatatacctgaaaacccatgcattcgggctcttttttttccaggggctggaaggaaaacagcccacctcggcaagccaacaatggggccttaggcatcccaccgccgccaaattggggaaggatg

SEQ ID NO: 46956 - DNA, 301 bp, Homo sapiens
  misc_feature 166: n = A,T,C or G
cagcccgtgggattttggtatttttttatgaaagcctgagcagactaatatatacatgatattaataaatctattaagaaaaataaaccatcatcttgatagtcactaaaatggcatttgaaaaataatcaacaattagttttggccaaaaatgttcaatataacnggaatcagtgcagatacagctccactaaatttaggaagaaaatgctagtcatttctgctagagtcaagtataagagaaaaataactggtatcaattttttatttgagataattgctagcataagtacataagaaa

SEQ ID NO: 46957 - DNA, 200 bp, Homo sapiens
cgacgggcccgcggcgggcgacacgatggtcttttattgaagagctctgcaagcggagctgcgaggcgctaacaaggctaaagtctgcaagacctcaaacagccctatatcactcagaattatgttccagtcgaattctgtaaaaagaaatcatgccctaatccgggagaaatacgaaatggacagattgatgcaccagg

SEQ ID NO: 46958 - DNA, 301 bp, Homo sapiens
  misc_feature 244: n = A,T,C or G
gacatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgnggttataaaacaattagcagaatagcctacatttgtatttattttctattccatact

SEQ ID NO: 46959 - DNA, 432 bp, Homo sapiens
acagaaccgaaacggccacagagggaaatgggaagcttttccccttaattgggcatctgcgtcagaaagtccagtatccctgagataggaaccactgtaattagaagattggaatgaacaggtttctcccaaaggaagattgtttgttgctgaattatgcctactgccctgatcatcaggtataaactttgcatcttccaacctaatgcttggcagcaccaagacgtttcagtaatggccatcataaacccagcattctccatcttcatgaaataactggaagacaaagaggaagaatttaggtacatatttgctttggacttctggaatatacttactatttcatatctgctccccaccccgccattagactgaaatgagttcaaggaggggccagcgacatcttggttataaacaggggttggcacatcc

SEQ ID NO: 46960 - DNA, 489 bp, Homo sapiens
ccgacatcttgacgaggctgcggcgtctgctgctattcttcgagcttcgcaatgccgcctaaggacgacaagtttgaagaaggacgctggaaagtcggccaagaaagacaaagacccagtgaacaaatccgggggcaaggcaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggttcaaagcacagagctcaagtaatttacaccagaaataccaagggtggagatgctccagctgctggggaagatgcatgaataggtccaccagctgtacatttggaaaaataaaactttattaaatccaaaaaaaaaaaaa

SEQ ID NO: 46961 - DNA, 108 bp, Homo sapiens
cccgaaccgcgcgcgaaggaaaaaccaccagtagggacaagggtgaaaacagaagccagacggcacaggtgcgcgtttggactaccgggagggtggggggccccatac

SEQ ID NO: 46962 - DNA, 220 bp, Homo sapiens
ccagaccgactccatcataatctatggtaatggtattgaggtccacttagtaaacctgtgacggcagatatgatctataactaacacattgtaatagttacagatagctatggctttgcaagcccatctgaccatactaataagtccctcacggagtcccttgaccgacaggccaaatgtacagccatcaccaagaagacgtatattggtatccgaatga

SEQ ID NO: 46963 - DNA, 227 bp, Homo sapiens
agccatagcttgtttattctggggtcatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatt

SEQ ID NO: 46964 - DNA, 398 bp, Homo sapiens
cttataatgtaaatcaagacttttatgttgctgtggaaatcgctatagactgctaccgataaaacagtagataaaaaatagaccaatgaggctgggtggcatggctcatgcctgtaatcccagcactttgagaggccaaggcaggcagatcgcctgaggttgggagtttgataccagcctgacgaacatggagaaaccctgtctctattaaaaatacaaaattagccaggcgtggtggcgcatgcctgtaatcccagctactgggaaggctgaggcaggagaatcccttgaacccgggaggcggaggttgaggtgagccgagatcgcaccattgcactccagcctgggcaacaagagcaaaaatagaccgatgaaacaagataaccccgaaaaaaaaa

SEQ ID NO: 46965 - DNA, 579 bp, Homo sapiens
acctcaattgaaattctagttctgtagctaattagcactgttgtcttggcaaagtattaattaggattctccagagaaacagaagtaatagaatgcatataaaatcaacatattgtatggataataattatgatattatgtatttattacataatataagaaattgtctcatgcaattatgaaggctggcaagtcctaaatttgcagagctgccgtactagtttgaagaaaggcaggcaggagaattttcttatttgtaggaaggttagctttttgcctattcagcccttcaactgattagatatggcccacctaggtaatggagggcaatctgctttattcagtctactgattcaaaatgttattctcatcaaaaaaacacgctcacagaaacactcagaataatgtttgaccaaatatccgggcatctcataacctagtcaagctgacacataaaattaaccatcatacttacactttatgaatccatttttataatctcatgagttgcttagagattaagtgagaaaatttgtgaagcataggcagagatagaggtcagaaaaaggtagccataat

SEQ ID NO: 46966 - DNA, 152 bp, Homo sapiens
agtcaagcacccaaaggtcaatgcacaagagaccccgtatggcatagcagctggcttctcaaacggccgaagttgcctcttttaggaatctctttggaattgggagcacgatgactctgagtttgagctattaaagtacttcttacacattg

SEQ ID NO: 46967 - DNA, 229 bp, Homo sapiens
aaaaaaaccctcgattatactctgttggacaaaccgtttgcaatgaatgaggcttttctgaaaatgaaagataacaagtgggtgaatgtggttatggccgaaaaggatatgcagtatgcttaatggtagcaactgaaagaagacatcctgagcagtgccagctttcttctgttgatgccgttccatgaacataggaaaatagaaacttgcttatcaaaaaaaaaaaaaa

SEQ ID NO: 46968 - DNA, 220 bp, Homo sapiens
ggggctgtggtggtgcctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattcac

SEQ ID NO: 46969 - DNA, 501 bp, Homo sapiens
atacccctgctgcgacgccccctggtcttacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataggagtgatctacgtcatctcagggcagtcctacagatgaagcaagagcttttgc

SEQ ID NO: 46970 - DNA, 405 bp, Homo sapiens
ttgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgcctgcaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttg

SEQ ID NO: 46971 - DNA, 100 bp, Homo sapiens
gaaactgcagagacgggaaaccctgccccccggaacgcaggaggggggaaagcgggggcgacccaaacgaagggcgcaagggggctgctaccaaggattc

SEQ ID NO: 46972 - DNA, 403 bp, Homo sapiens
ggatttaccttataaatatataactgactaagacacacagaaaacatattgcagagtaacatagatgacagaacttgaaatacatgacattctaccgcagtctatcattattttctaacttatcaaaagactcagaggatcttttttttcgtattgataaatttttaactagagccctatttacttgtgcttgaaaaacagtatttgcaaatatgtttgaagaggaaacagaaagaaaatgattccaaaaaagctgataacattaagacatctggttatagaagatgtaaatttgcaaccattaaaagcttataggagctacacagaatgggaagaaaaataaatgaaccaaccgctacaagaaataaccaaactaagaggccgcaaaaaaaaaaaaaaaaaa

SEQ ID NO: 46973 - DNA, 349 bp, Homo sapiens
taggcagcattaaggcccaggtatattgagtagtccaaaccaaaaaactatattcgagtatcagtttaaattcttccaagccctaaaaattcttacgtagtttctcacctaaaactaatggcttgtgccaagaactgaaactaagctattgattttttttttaagaagcttaatctatacataagaaattacatacctggccaggtgcagtagttcaggcctgtaatcctaacaaacactctgggaggccaaggtggcagactgcttgagctcaggagttcattaccagctgggcaacatgataaaaccgtgctttacaaaaaaaaaaatttttaaattagccgggctt

SEQ ID NO: 46974 - DNA, 350 bp, Homo sapiens
tttttgccaaaacctcggatgcgtggccttctggccaggcggctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgcactgcttgtgtcctgactatgacacatgaatatgtggctaagaaataggtcctcttgataaataaacaattaacaaaaaaaataaa

SEQ ID NO: 46975 - DNA, 330 bp, Homo sapiens
tgaattctgtaagtggtgactgctcgagcacctttcagaatgatgcatggggaaaaaccagtgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgcatattgaaaaatgatttgcatagtactgaatgttgcacacagcttatatgtatttacaagaatatctttaagtgttttttgacacattaaaataaaggaaaaaaaaaaaaa

SEQ ID NO: 46976 - DNA, 438 bp, Homo sapiens
catgtctgagtcggagctcgcaggaagttggacccggtgtcttggcggatgcggccgtgaagataggtactggttttggattaggaattgttttctcacttaccttctttaaaagaagaatgtggccattagctttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgcattcttctgtaacaatgttatcaagtaatgctttaaactccagcacctggttatgcattttgaaaccaagctggttcttggtttggatttctctctggaagtgtaaggaggtggc

SEQ ID NO: 46977 - DNA, 397 bp, Homo sapiens
cacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagaccccataataaaatatcatattaca

SEQ ID NO: 46978 - DNA, 250 bp, Homo sapiens
acactagaggatccaaagaattcggcacgaggaattttaccataaaaacagtataattcttaggttcttatgtcagcctacaaaagtctgtgctattctaccctgtctataaaatgtagtattattttacctaattgccatttagaacattttttcaaggatgaactttaatactgaaattctgagatatgacttttagttcagagtttatgaattgggcatcggtagggtgtatacagtgcatgcagga

SEQ ID NO: 46979 - DNA, 365 bp, Homo sapiens
  misc_feature 326, 338, 339, 344: n = A,T,C or G
ccagagagccacaaatgaccaaaatattttgagatgaacatgctcgtagaaggtagctgactagggggtacttgaaaatgctagaccaggataactcctaagtgtatatccttggcagactcgttatgctttccaatcctgcttgcaatataagacacaaagtcagaataaagctcaagaaaacagaacgtgcaggccatcaagcgcagagcctgctcattggacaaccgcaaagagtagtaagtgctgccgctattcacacttagaaaaggagaaccacggggaaaaaccaaattaatggggctgctttttgtcactctggcatnagagaattgtgnngaaantttaacttttgtaagcttgta

SEQ ID NO: 46980 - DNA, 247 bp, Homo sapiens
gagaacagataaagattgtgtggtgttttggatttgttgagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaagacaaaaaaaaaaaaaaaaaaaaaa

SEQ ID NO: 46981 - DNA, 579 bp, Homo sapiens
cccgtctctaagacaaataataaacgtcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattatacccataactacatgcaattattatttgtcaattaaaaatacaaatctaggccaaaggtgggaggattcctttgagcccaggagttttgacagcagcttggggcaaccatagggagactcctc

SEQ ID NO: 46982 - DNA, 210 bp, Homo sapiens
agcaaactggagcagaaaccaccaatgcttgctttgagccagccaaccagatggtgaaaagggagggggcgccagggaaaactcatggcctgatgacaaacgcaccattgaaaacgcaaactctgaactttttacaaagaaaaatggcaaaaactttgtatggtacgctccatgtcagaagtgggttgtggccccgctggcgtcaaggta

SEQ ID NO: 46983 - DNA, 184 bp, Homo sapiens
  misc_feature 158, 160, 162, 164, 165, 168, 169, 175: n = A,T,C or G
gtgcggaaccagtagctcatagattgaccataaagttttgagggaacacggcacgacaaaccattccaagggggggctttataaagctagacaggaccacccataatccgggtaaccaggtaagatcatgatgctgtactaaaaggggctagaattanangngnnagnngaaaangaaagaatg

SEQ ID NO: 46984 - DNA, 538 bp, Homo sapiens
ctcgcgctactctctctttctggcctggaggctatccagcgtactccaaagattcaggtttactcacgtcatccagcagagaatggaaagtcaaatttcctgaattgctatgtgtctgggtttcattcatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaggggttataataatggtaacatggacatgaacttctttataatctactttgagggccggcctccatgtttggaaggatctgaacaggttg

SEQ ID NO: 46985 - DNA, 168 bp, Homo sapiens
atgaaaacgattgcatgtccctagccagagtgaaatgttaaagcgagcacaacctcataggacggattatttaatgaagttgttgagagtatatatagtggtattgctttattaaacttaaactcaaataatattttgattaaaatttttaataagaaaaaaaaaaaa

SEQ ID NO: 46986 - DNA, 374 bp, Homo sapiens
agagggaacatgctgtgaaactgatgaagctgcatttccaacgaggcggccgaagctaccttcaggatttcaagaaaccagactgcgatgacggggagagcggccgaacgcaatggagcgtgcattacattgggaccaaaatgggaatcaggcaccactggaaccgcacaaactggccaccgacaaaagtgacccccatttgtgggacggcatggagacacattacccgaatgagcaggcgaaagccatcaaagaattgggtgaccacgggaccaacttgcgcaagatgggagcgcccgaatccggctcggcggaatatctctttgacaagccaccctgggagacagggataatgaaagctaagcctcggctaa

SEQ ID NO: 46987 - DNA, 147 bp, Homo sapiens
cgacgaagtgcggggcgactgcacaaccgggctccgagcctggcgccaacgggggcctgaggcggccgacacgctggttttttcagacacgggcttggaggcggagcaagttcaacaaagattctgggaagttttaaaaaaaaaaaa

SEQ ID NO: 46988 - DNA, 387 bp, Homo sapiens
accctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctgccctctgcgtcttccttattaaccttgaatcctcattaaaggtttctttacccc

SEQ ID NO: 46989 - DNA, 523 bp, Homo sapiens
ataaaacaaaacccaaatagatggagagacagaccacgttcctggataggaaaacttaatgttataaaaatgccacttattttgaaattaacatataaatttaatgcagttccaatcagaatttaagtcttttttcttttggaatacatgaagtgattataaagtatatatggaagaataaacacatgaaaattgcccagaaaatgttgccctactttagtaggcaactttagtaggctgtttgccctactttagtaggctgtttgccctacttgatgttaaaatcttatataaaactactttaaacaagaaaacatagtaccggcctgcagtaaacaaataattctatagaacaaatcgagataatttagcatataattaatgaggccattataagtcagtgaataaattattcattattcagttaatgaaattgagagaactggctgtacttttggaagagattaaaattttatttccagcctgccagtgctcctcctgtaatcccagcactttgggaggc

SEQ ID NO: 46990 - DNA, 341 bp, Homo sapiens
tacttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgt

SEQ ID NO: 46991 - DNA, 364 bp, Homo sapiens
atacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtca

SEQ ID NO: 46992 - DNA, 472 bp, Homo sapiens
ggaaatagcaaattctcctacacagttctggaggatgggtgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgtccaccaaatacaattcaaatgctttttgttttatttttttaccaattccaatttcaaaatgtctcaatgggctataataaataaacttcaacactctttatgataaa

SEQ ID NO: 46993 - DNA, 158 bp, Homo sapiens
gaacttagtatcataccgcggcccacccaagaacacggatcggtctaagaatatcgaacacgcaaggctgaaaagactacctatagtagatatatgcaccctatgacattggtggccctgatcaagaatttgggtgtgggacggtggcccttgtccgc

SEQ ID NO: 46994 - DNA, 352 bp, Homo sapiens
ttcaactggttagtgtgaaatagtgtgccacctctgacgcaccactgccaatgctgtactgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtg

SEQ ID NO: 46995 - DNA, 204 bp, Homo sapiens
tttctggctttgctacaggagcaggtcagggaggtaatggcttagtaatactgaaggaacctctgatcacaaaggtgaattagtaagtactaaatacacagcaagaacattgttgtagcagcagtggcatcaatattggttgttattgttattacatattcctttattttgcttcttgcatttatgaccgtggctgtggaccag

SEQ ID NO: 46996 - DNA, 149 bp, Homo sapiens
tacctacgacatggcagctgcaacaagtgaaactatcaatttgaggtttatcagtaatacattaaatttgaagtaatattctcccaagtaatcctagcgcttggaatgaatgaaggatcatttgaaaaatctgcaactcatttctaaaa

SEQ ID NO: 46997 - DNA, 570 bp, Homo sapiens
aacaaaataaggtccctatctttaaagaacttgcaatcttattgttgactactctgattgtattgggcacaaagcgattgcctatataatctttgacaaggtctaacattattgtgcagatatcatttcagcagatagtgaagtgtttacttttgtgtttcttgacaggccttgtatgaagcaggagaaaggagaaaggggacagacgtaaacgtgttcaataccatccttaccaccagaagctatccacaacttcgcagaggtaacaataaatttctttttctgcaatctgtttatggaagatgcaattttcttttttgatgacaaataagagaaagtaaaaacagaaccctttttcaatatcactcctgtatcaaacagatacagtgttcctgacccattgttatttgtcaatttgccaattttgtacagccgctactttatcatatttaatacattttgtgacttgggcatgtggaacataatttggtatttcactgcttttactcccctaaaagattggaatatgtgtgggaaaagactgcctaacagaccaaatgaaattagatg

SEQ ID NO: 46998 - DNA, 457 bp, Homo sapiens
ccacactgctcatgtcagcttgtactaccctcccctttgaccccagataacccactgtatccaaccttctgtatgttttctccttaattgagtaatcactgacagacacatttacattgtatgcaaacacacatatgcaagtattagagattttaattgttattttacaaaaatgggatcatattctattacactctcttgcatttcgcttttttatgcaatagtacttcaaggaaatcccccgaaataaactgatataagtttcacataatttttgacattacataatattccatagcgtgaatattgcacgatttattcagccattcacctattgatgaacaatagctttatcttttctttaactataaacatgaggcaaaaaattctattcctatgcctatactctctaggggttgtgttctcatggaatgaatgcctagaagtaaatcaatgg

SEQ ID NO: 46999 - DNA, 102 bp, Homo sapiens
acaatcaaccaacaagtcattattaccctcactgtcaacccaacacaggcatgctcataaggaaaggttaaaaaaagtaaaaggaactcggcaaatcttacc

SEQ ID NO: 47000 - DNA, 154 bp, Homo sapiens
atcccatagtgaaatgctcaaatactgagtgccttatagtattcaacaaggacaacatgagacgtgggcggtattgcaatgatgaattaaatccacctctaaaaaaaaaaacaaaaagtttagaaaagacttgtccacccctttgcccaggaaa

SEQ ID NO: 47001 - DNA, 334 bp, Homo sapiens
cataactgattatgcttatgtacttacttacacatttttaactttatgaccagcctaaatattctgggggaagcggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttaccctggaggactcgtac

SEQ ID NO: 47002 - DNA, 101 bp, Homo sapiens
ggagactacgcttgaccccatgtgaggcatgaggtttgcattgtagccgtagatcacaccattgcactccaccttgggcaacaaaagcaaaactctgtctc

SEQ ID NO: 47003 - DNA, 491 bp, Homo sapiens
tgcacattgcctgttctgcttcgaagtattcaataccgttcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtgggaaagacaactgttttaaataaaagaatttcctttcacca

SEQ ID NO: 47004 - DNA, 176 bp, Homo sapiens
agcaaaacagtctttgaatatcgaacacgcaaggctgcgagactacctattgtagatattgcaccctatgacattggtggtcctgatcaagaatttggtgtggacgttggccctgtttgctttttataaaccaaactctatctgaaatcccaaaaaaaaaaaaaaaaaaaaaaaaa

SEQ ID NO: 47005 - DNA, 283 bp, Homo sapiens
tgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgt

SEQ ID NO: 47006 - DNA, 501 bp, Homo sapiens
tgcgtgagctatgtggaaatgaagacgacaacgttgtcttagcctttgaacaactgagtacaactttttgggaaaagttaaacaaagtctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgctaaaaaaatgcgagaatgttgtatgtgactgaataacaattttactctgcgaagcccaagtaaatataatattatcagtactttatccccagggcaggatttataaaaaggttattagggttgaaaaaatggat

SEQ ID NO: 47007 - DNA, 233 bp, Homo sapiens
aggaaaccgcagataagatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 47008 - DNA, 407 bp, Homo sapiens
taaaaacctcatgtgatgctgtcatacatagttcaattgagcttccttaattcacttcatttaccttttttgccattttcgtttgagaactagagaagtttgtgttctgttggaaccctctgtagaacactttacactcagttctgatggaccttttcaggggcgattttttaaaaaccgctctcgaaagtagtcttaaaatgagagcactttattgatggcttttcaggactgtgttggtatttttcatgcagtgtatttgtcagcttacatttttcaagttgagctacctgatgctactgacacacatatgattttcctatcttaccaggcaaatactactgttaacgttttaatagtaaggctacttatgcacattgattttactttgaaaaaagaactggttt

SEQ ID NO: 47009 - DNA, 363 bp, Homo sapiens
aatgcatagtacaactgcccccaccccccaaaaaaagtctcatccagaatgtcagtagttctgaggttgagaaattctacctataagcaaatggacattgttgtgttccaataaaactttatttacaaaaaataatcagaaggccacatttggcctgtgagctatagtttgcttatctctattttaaatagctttttgctatatgataatatagttttctgtatttgttcctgaattgtctcattcaccccaaatatttttccaaattttcttctattttatgcctttaaacctttactaaatacaaataatacacagaatcaatagcccctgtgtaactaccacctaataattaagcatgtt

SEQ ID NO: 47010 - DNA, 535 bp, Homo sapiens
aagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaaagtaaactatgaagaagtttgtacaaatgatgacagcaaaagtgaagaccttgtacagaatgggtaaatttcttgacaaaattgttatttgcctttctttggttggacttatct

SEQ ID NO: 47011 - DNA, 246 bp, Homo sapiens
atcaacaaaaataagcaatggggaaaggattccttattcaataaatggtgctgggatagctggctagccatatgcagaagactgaaactgcacctttcaccacatataaaaattaactcaagatggattaaagatttgaatgtaagacttcaaactataagaatcctaaaagaaaacctaggaaacaccattctggacatcaaccttgggaaataatttattgctaaatccttagaagcaattgcc

SEQ ID NO: 47012 - DNA, 258 bp, Homo sapiens
ccatttgaattttttagcgactaatccatagttcattttatagtgcatatatacatatgattgcctgtgtaaagagaaagttagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgccattgtaccccagaagctatccacaacttc

SEQ ID NO: 47013 - DNA, 586 bp, Homo sapiens
tgagtatctcgctgtgtttaagaagactgtgtcctcccttgaagtctttcttcagcggctttcttctcaccctgttctcagtaaagatcgcaactttcatgttttcctggaatatgatcaggatctaagtgttaggcggaaaaatactaaagaaatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatctacatgctcaacattgaagctgctaaggatctcttatacagaccaccaaagccctcattgactatgagactcaaacaaagctctg

SEQ ID NO: 47014 - DNA, 341 bp, Homo sapiens
attggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagagaaatgatacttctctttttttgctgttccaccaaatacaattcaaatgctttttgttttatttttttaccaattccaatttcaaaatgtctcaatgggctataataaataaacttcaacactctttatgataacaaa

SEQ ID NO: 47015 - DNA, 284 bp, Homo sapiens
tccctaaaaataataggaataatataaaacttagagttttattttattattttatttatttatatttttatttttttattacaggcgtgagctaccacacccagcctaaaacttacaattttaaaaaaattgactagaaggactactagaacagaatagaaaatctccccaaataggcccaaatactgaaggaaatttagtttacaatgaagctagaatttgaaatcagtggagatggatataccttttaataaatgcgctgtaacaactggatatttatatgg

SEQ ID NO: 47016 - DNA, 547 bp, Homo sapiens
taatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagctagaacagaaagatgtgaatctcttcttaaatattttggtacttttggaagtcgaaatcttccctcctgaagacaagaaagccatacgatcaaaatgaagaa

SEQ ID NO: 47017 - DNA, 535 bp, Homo sapiens
cagcgcaggggcttctgctgagggggcaggcggattttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaagagattaaaccgaaggtgattaaaagaccttgaaatccatgacgcagggagaattgccgcatttaaagcctagttaacgcatttactaaacgcagc

SEQ ID NO: 47018 - DNA, 595 bp, Homo sapiens
atatggaaccaaaacagaacctgaatagccaatgaaatccttagcaaaaagaacaatgctggagacatcacactacctgtcttcaaaatatgacaagggcattgtaacctgaacagaatggtattggtatagaaacaaacatgtagagtaatggaacagaatacaaaacccagaaagaaatccatgtgtttacagccaaattttttttataaagttgccaaaaatatacattgataaaggacacaccctcttcaataaatgttgctgggaaaagtggatgtccacatgtagaagaatgaaactaaacccctatctctcatcatataaaacaatcaacccaagatggattcaggacttaaatgtaagacctgaatctataaaactactagaagaaaacaggggaaacacttctggatattggtcttggcaaagattttatggctgagaactaagcacaggcaacagaaacaaaaatagacaaatgatactctattaaactaagaaccttttgcacagctaggaaacaatcgacagagtctctgaagagacagctggtggagtgggaggaaatatttgtaaatgatatcccacaagg

SEQ ID NO: 47019 - DNA, 544 bp, Homo sapiens
acaaccctctctcctcagcgcttcttctttcttgttttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgcatgatgtgtaacgaattctttgaaggcttcccagataagcagcccaggaagaaatgaaaactcctctgatgtggttggggggtctgccagctggggccctccctgtcgccagtgggcacctttttttttccaccctgctccttcaaacacgtgcttgatgctgaacaaagtcaataaaaaatcttggaagttt

SEQ ID NO: 47020 - DNA, 100 bp, Homo sapiens
agagaaagggccccgctcaacttgggcggcccgaggcgagccttcgactgagacgcaggggaggacaggcccctagtcctcaggccttctttcttatcca

SEQ ID NO: 47021 - DNA, 221 bp, Homo sapiens
  misc_feature 39, 42: n = A,T,C or G
agaaagcgttcaagctcaacacccactacctaaaaaatnttnaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaaaaaaaaaaaaaaa

SEQ ID NO: 47022 - DNA, 300 bp, Homo sapiens
gtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaa

SEQ ID NO: 47023 - DNA, 300 bp, Homo sapiens
  misc_feature 6, 12, 250, 282, 291: n = A,T,C or G
gcaggnacatgntaacacttaaaatggtactcggggacctccaaagactaaactggcaagccttcaaggagcccaggggtaagttaacttgtcaacggcatggtttaatcccttctttacacttgtgtaaatttcagttactggcatagaaggctttcaatgttgagtggcttttattaacatgtttatggtactgcatagatacgggtatttattttaccctaagaagattttgaaggttaaaagtctnaaactatttggcaaagatttggttttaaaaanctatttggncaatctaaa

SEQ ID NO: 47024 - DNA, 489 bp, Homo sapiens
tctaaattctcacaaaaaggtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtggctgcatggtggacagagcccttctctgtaaaatggaaatgacaccactagccatctcaatagttacaagaattaaaagagatacagtacctgaagtgcttagcgcatggtagcatttcataaatgttagtgtcaatactaatgctctaataatgtaaatg

SEQ ID NO: 47025 - DNA, 558 bp, Homo sapiens
tttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtcagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgtagggattgttcacatgtgtaacgttttggttgagatgttaaatgggggacgagaactgtggatgtgaatgggggaagtaatttaatcatatggaattgggcacaaggcctaaattgcaggaacctatttgctgtttttatttaaacaatggccttggtgctttgg

SEQ ID NO: 47026 - DNA, 251 bp, Homo sapiens
ggcaaaccaagaccacttgctctttatgagtttcaaccaacatgaagagacgagctgtggggatcggggcactgtggtcctgcatgaagacagaaggcctggcgtgtgcctgtgaccgtacaataccacttccgcatgtcacggtaaagtccgccatcagaagactgaaggagttgaaagaccagtagacgctcctctactctttgagacatcactggcctataataaatgggttaatttatgtaataaag

SEQ ID NO: 47027 - DNA, 196 bp, Homo sapiens
ggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggt

SEQ ID NO: 47028 - DNA, 583 bp, Homo sapiens
gaagagagagaaagcagcatcttgcctggatgagccaggggacacagaagagaagcccacatatctcatttaatctttacaactctcttgcaaggttccctggttgtgaaaatacatgagataaatcatgaaggccactatcatcctccttctgcttgcacaagtttcctgggctggccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagtagtcctggagcatttacacctttggtgaagtggaacgactttatctgtccaagaatcagctgaaggaattgccagaaaaatgcccaaaactcttagga

SEQ ID NO: 47029 - DNA, 370 bp, Homo sapiens
aggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctaaa

SEQ ID NO: 47030 - DNA, 399 bp, Homo sapiens
aataaaagaattacatatgaaaaaccctctaaaccatggcacttgatgtgatgtgcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaagg

SEQ ID NO: 47031 - DNA, 300 bp, Homo sapiens
gaacgtgtgtgtcctgagttctcatctgaaagctttcatatcggttgactgcagatttgatttgtatccactgtcaccagcactgctcacttaggactttctggatccggacccaggcagcgcacactggactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacaca

SEQ ID NO: 47032 - DNA, 131 bp, Homo sapiens
ttggtaaagcaataccaatggctttttatcatttccttcttccctttaagtctcacttgaaattttaaaaatcatggttatttttatcgttgggatctttctgtcttctgggttccattttttaaatgtcc

SEQ ID NO: 47033 - DNA, 110 bp, Homo sapiens
gatactgcttacagagtttcaaagcaagcacaactcagtgccccaacaaaacagttatttccaggtggaactttcccagaagacttttcaatactatttacagtaaaacc

SEQ ID NO: 47034 - DNA, 210 bp, Homo sapiens
aacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttc

SEQ ID NO: 47035 - DNA, 327 bp, Homo sapiens
gcaatgggtcttagctctttctctattatgttatcatcctcccttttttgtacaatatgttgttgacctgaaaggaaggtttctattcgttggatgtggacctggacaaagtccaagtctgtggaacttaaaaccttgaaggtctgtcataggactctggacaatctcacaccttagctattcccagggaaccccagggggcaactgacattgctccaagatgttctcctgatgtagctttgagatataaaggaaaggccctgcacaggtggcttgtttcttgctagcatggtcagaggaacagtccttgctcagaagggggctctt

SEQ ID NO: 47036 - DNA, 399 bp, Homo sapiens
tagggttttactgaaatctatttttaactcttatgttcgaagagaaattgtttcaaggattttgagtcataggtctgtaatttatagagatctctagaattcttattgtaattctcctacttctttgataaaagaaaaataagtcagattgctaactccaagattgaaaaaaaaaactcttgaaagaagattattagttgcaactaatttgggggttctgggcacagacatctaacctggtattgtaaggcagaggctcccattggaatggtagtggccgggccagttgttcatggtgtaagctttgcacagtgtattaacattgggagggtctggcttgaaaatttggccccctcagcctctgaatgtttattaaaataaatttagtctttctttgct

SEQ ID NO: 47037 - DNA, 430 bp, Homo sapiens
atttttggaaggtattattggcataatactcgctgatggtttacatagcattcaaatactagcttctcaacctctgaagttgacagtgctgtaagaaaaaaattcaatcttgtttctgcctttttggaattctgataaagctccctcctgtcatttagaataatgcttctgtctaaacagtttttattgcaaaaaatgacttaaaatgaacagtgtcagaaattgctgttggtaacaaaaatgaatggggaaaaaacttgataatgattgaaaaacggataaacaaccttccttctcaattcttttgtgattttcttgacttggggaaagcttggaagtgtgataaggaaagagaaatgctaaaatgttgccaccagggtgggggataatatagggaggcagagcagggggcctgctatctacatacatg

SEQ ID NO: 47038 - DNA, 209 bp, Homo sapiens
cagaacacatatatcacacaggttatgttggaactttcccaacgaagggcaatgtaaatggactcgtggagagagctttttgagaggttcacaggggatactgaatcttttagaaaatcaaggattagggattccagctgtatgtctttttctgttgcagttaaaatttttagtacttaatagacttcttggtgtgatagcaaaaaatg

SEQ ID NO: 47039 - DNA, 489 bp, Homo sapiens
actccgcgggccttcggcagatgcgggcctggggtagtctcctttctggactgagaagagaagaatggagaagcccctcttcccattagtgcctttgcattggtttggctttggctacacagcactggtgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggataaaaatctgcatcttccactattttcaatgtattaagagaaataag

SEQ ID NO: 47040 - DNA, 422 bp, Homo sapiens
atgtgaatgagtactgtatgtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatcagggggatacctgcctgtttttcaaagtgtttatttactgctgttactatttgattagaatgtattaaataaaaaaaacctgatttctt

SEQ ID NO: 47041 - DNA, 345 bp, Homo sapiens
tcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctact

SEQ ID NO: 47042 - DNA, 166 bp, Homo sapiens
catgtaagacacagcctgtcacattcaccagtggttccaaggttatttgatggtaaatgcctgtaatcctagctccacaggaggctgaagcgggaggatcctttgaacccaggagttcaagaccagcctgaccaacacagcgagactccaactaaaaaacaaaaca

SEQ ID NO: 47043 - DNA, 386 bp, Homo sapiens
aaccacggcagagagcagcgccgatgtgaagatgattgaatgtaactcctggtgtgaagatgaatgtgaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtaagttttatttccacagcccattaccatagcaataagaaaggaggcatagtacatagttggaaaagctttgtggggggatt

SEQ ID NO: 47044 - DNA, 495 bp, Homo sapiens
taagggctgaggatttttggtcttcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgtt

SEQ ID NO: 47045 - DNA, 235 bp, Homo sapiens
atataaagcaaagaacaacacagtcactcctggcggcaaaccaaacaaaaccagagtcatctggggaaaagtaactcgggcccatggaaacagtggcatggttccgtgccaaattccgaagcaatcttcctgctaaggccattggacacagaatccgagtgatgctgtacccctcaaggatttaaactaacgaaaaatcaataaataaatgtggatttgtaaaaaaaaaaaaaaa

SEQ ID NO: 47046 - DNA, 115 bp, Homo sapiens
gtctctctgatgtgtgccttttgttcaacacagttacccctgcattctgctctgctctaatacactacctggagaaagtcttttccttattttcaataaatgtcagacattatgg

SEQ ID NO: 47047 - DNA, 427 bp, Homo sapiens
atcataagatctctcacctcaatgccttgggttagttataataatgagaacaacaactaatgccaacagtaatagctgctgacgtacattgagcactaactgtatgcaataatatgcaaggaactgttaaacattcacctcggctgggcgcagtggctcgttcctataatcccagcactttggcaggcagaagtgagcagatcatctgaggtcaggagttcaagaccagcctggccaacatggtgaaaccctgtcgctatgaaaaatacaaaaattagccaggcgtggtgccatgcacctgtgatcttagctacttgggaggctgaggcaggagaatcacttgaacctgggatatggaggttgcagtgagccgaggtgatgccactgcactccagcctgggcgacagagcgagaccctgtctcaaca

SEQ ID NO: 47048 - DNA, 140 bp, Homo sapiens
cttgggggggattcttctctaatctttcagaaactttgtctgcgaacactctttaatggaccagatcaggatttgagcggaagaacgaatgtaactttaaggcaggaaagacaaattttattcttcataaagtgatgagc

SEQ ID NO: 47049 - DNA, 248 bp, Homo sapiens
aaggtgttaggtgtgactgtcacaactgttatgccttccagtaaactagaagtacgatatttgataattatatttgtatttcaccacctaaatgtaatgttgattcctcaagaatgaaatgaaggcactacattgaaatatgttttgtataaatttgcatgttgaacagcattttagcatggtaagttcccttagctatatgaattttggcatgtttcagagagatcagtaaataaaatattagaaaa

SEQ ID NO: 47050 - DNA, 187 bp, Homo sapiens
cgatcttgttcattgattagaagatttaatatagaagtatatcaattcttctcatatctatcagtttagtttggttcctgccaatgctccatcaaaagttttgcgtagacacagacaaggctacataaaatttatgtggaaaggaacagaccctagaatagctaaagcaatctttagaaaaaaaaaa

SEQ ID NO: 47051 - DNA, 435 bp, Homo sapiens
ttcttcctgttttctagaatgtgattttaccctggctggcacagagtaaatgcccaaagaatggtagctattgtttttaatcatcattattaattttataaataacttccatatcaggtgatgggaaaatttcagactttgatttgggccttggaaaacaggttcagtttcagtagatggaggtaaaaggaggcaaagagcgaccttacgtaaatccaaggctgaaggaaggaggctctaaggggtgtgtgggtgattaggagtaaagtatcttgctgaaatgaagagttctatacagcatgcttatttggagcatgcctaacaagattactttgggctaattttggaagcttgtactccagggagcttggacatgaatttaaagacatgggacctcacatttaagttctgaaacagccagcgtgtggctcatgc

SEQ ID NO: 47052 - DNA, 214 bp, Homo sapiens
gatttctttacctacccctcagttttccttaaaacgcgttcacaactctagagagggccaagaataatgtttcttggttaatgtgttatttatggagtattgtttgcgctaagcattgtgttagatttaaaaaattagtggattgactccactttgttgtgttggcccattgttgaaaataaatataactttgtattcgaaaaaaaaaaaaaaa

SEQ ID NO: 47053 - DNA, 404 bp, Homo sapiens
  misc_feature 404: n = A,T,C or G
ggtctagggaggaagaagttgacacacttggtaacggctgctgcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtcagcttttgcccagtttgtttctccatttactggatgcatttatggaaggcacattacaggtctttgtgggaagaaacagaaagaaatcacaaaagcaattaagagagctcaaataatggggtttatgccagtacatacaaggatcctgcacatctcaaggaccctaaagtttgaacatcagatatcgggaataaatctatn

SEQ ID NO: 47054 - DNA, 501 bp, Homo sapiens
ggtcagtaagggctgaggatttttggtccgcactctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattggatgaccagtcgg

SEQ ID NO: 47055 - DNA, 249 bp, Homo sapiens
gcttagcaacatgaaggaaatttttttttaggtttgtgatgataattcagctaaaccaataaacatgtatttattgactgcactctgtcttaagtgtgagtaaacctcttctaaaaatcttgttcttgccaagaaatttataaatcacatacgaagacgtctgttgctaacagttaactttatgaggtaactatatccttctatttctctggactcatttttaaaaaatatgccgaatactgcatactg

SEQ ID NO: 47056 - DNA, 145 bp, Homo sapiens
gtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatt

SEQ ID NO: 47057 - DNA, 351 bp, Homo sapiens
ctcatgaccaacacatacacgtcatagaagaaaatagaggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgccccctta

SEQ ID NO: 47058 - DNA, 376 bp, Homo sapiens
gccggaaccgccatcttccagtaattcgctctaaatgacgaacttttaggcaaagaggagaggcacccgatatatggggtctaggcctttaagaaaacatggaggagttccttaggccacatatatgcgaatctataagaaaggtgatattgcagacaacacgggactgggtctgttcaaaacggaatgccccacaagtgttaccatggcaaaactggaagagtctacaatgttacccagcatgctgtttggcattgttgtaaacaaacaagttaagggcaagattcttgccaagagaattaatgtgcgtattgagcacattaagcactctaagagccgagatagcttcctgaaaccgtgtgaaggaaaatgatca

SEQ ID NO: 47059 - DNA, 439 bp, Homo sapiens
tttactgtatgcattgatttttttcaaataagtgttttgcagttttatattcatataaatgaggttaagtattattttgtcaagtactcagtatatttctacagaatttctggttgtattatttatagtttctttttaaagatagaaactgaaaactgtgcttaagatttcacatagaataatgatggagtaaataaagtattgttattttgggctaagctgggattagagacttgtttgagttagaactctaacatgtagaatttaaaaaatgaatttctgtgatatcttatgggtacatcattggaagtagcctaatccaaggttttttaaatatgagcctttaagattcaaatttgactgagcatcttaaacccctaaacaatgaaatgctaatgtcaatgttattagcctggcgactgagcgagggtctgtctcg

SEQ ID NO: 47060 - DNA, 489 bp, Homo sapiens
  misc_feature 473: n = A,T,C or G
attccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtataatgtcttagattaaagacgttgcctttaatatctgttgggaaggaaatgtccagacttttcaaatctcttattatatgtttcctttttttgtttacatagggaacaatgtttatagtcgtgtgtacagtgggggctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggnttagtatttttgcctg

SEQ ID NO: 47061 - DNA, 574 bp, Homo sapiens
tgagtggttgtgtggtcgcgtttcgtgaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggcaagtaaactatgaagagtttgacaaatgatgacagccaaagtgaagaccttgtcagaatgtgttaaatttctgtaccaaaattgtttaatttgccttttcttgttgtaacttatctgtaaag

SEQ ID NO: 47062 - DNA, 375 bp, Homo sapiens
ccaacagagaggcttatttgacttgatgctaaagagatgaggatactgggatgggcccagaagttcctgatgaccgctacttcgagccctccctaggcccagtgaccccttccgctgtcaatgccatctacgagtggtccagtgttctgatttgggtctggacaaagtgccaaaggatcttccccctgacacaactctgctagacctgcaaaacaacaaaataaccgaaatcaaagatgggagactttaagaacctgaagaaccttcacgcattgattcttgcaacaataaaattagcaaagttagtcctggaagcatttacacctttggtgaagtcggaacgactttatctgtgcaaagaatcagctgaaagga

SEQ ID NO: 47063 - DNA, 203 bp, Homo sapiens
cgggcagcccagtcggggggaaaccacgataatcggaagcagccgaccactagcaatatcaaccaacgaaccctaccgatacacgtaggaaacggacacaattgccaactctacagaccacccaagaaaaggcgcccgccttaatccaacccggcgacaacgcacatcgaggaagcctctaccggcacgaccacccggaaaga

SEQ ID NO: 47064 - DNA, 477 bp, Homo sapiens
tttttcgaattatttataagacgatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatctaaatgggtaaagccatttacataatatagaaagatatgcatatatctagaaggtatgtggcatttatttggataaaattctcaattcagagaaatcatctgatgtttctataggcactttgccactcaaaagaaaccaataccctatg

SEQ ID NO: 47065 - DNA, 534 bp, Homo sapiens
tcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatggctgctactgtgtggagaaagatagacagactggaaaaatattgaaggtgaacatgtggcgtatgctgctatgtgaagcagtagctgctgtcatgccaaggggtttgatatcctgggaataaaacctgtccaaaggatgtaatcctcataggtttgaacactgtgtgtttttaccaaagtggccattgcactgttgcttttttacaatcatgtggacacaagcctaagtaaagaaaatttggcaaccc

SEQ ID NO: 47066 - DNA, 101 bp, Homo sapiens
ctaaggaccgagccataagacgagggcagcacacagcctgcacttcctagaagaattaaagaccgaacagcaaagggggggaagagaatagaagaaaggga

SEQ ID NO: 47067 - DNA, 270 bp, Homo sapiens
aacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 47068 - DNA, 193 bp, Homo sapiens
acagcgaatgtttataggtggttatttaattcatctatgaaaatgacttaagtcaggcacagtggctcgcgcctatactgccagcactttgggaggtcaaggtgagatcacttgagcccagaagctccagaccagcttgggcaacacagcgggaccctgtcctgacaaaaaaaaaaaaaaaaaaaaaaaaaaa

SEQ ID NO: 47069 - DNA, 458 bp, Homo sapiens
tgctcaaggtcatcaccaaggtctggttgcaaaaattcaaaaaattgcaacctcaggcataaatggcttaagcccaagagatggcactgaccataaatggtggcttgtgtgtgaagggtttggacttcaagatatactaacacctagaaaactaaaagtgcaattgacccccaattactattttagtttgaggtatcaagggcatttgccaatctcttatatgtagcttctagagttgtgctgtccaatattatatccactagccaacgtggcttttgaaattaaaattaattaaaattaaattaaaaatgtaattcttcagtcacgccagccacatttcaaaggctcaatagccacgcctggcttgtggctccatattggataacaagaaacacttccgtggttgaagaaaattttaatggacaatgctgtgtttcatttgaattcggtgtccttga

SEQ ID NO: 47070 - DNA, 380 bp, Homo sapiens
atacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgcaaataccccttccaaaattatacttgtatttaaaaaataaatggatctacctaatttctattgattt

SEQ ID NO: 47071 - DNA, 485 bp, Homo sapiens
aatgtacatgggccgcaccataatgagatgtgagccttgttcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctgggaaggagcttcagtattgtggggctcataaaacatgaatcaagcaatccagcctcatgggaagttctggcacagtttttgtaaagcccttgcacagctggagaaatggcatcattataagctatgagttgaaatgttctgtcaaatgtgtctcacatctacacgtggcttggaggctttatggggccctgtccaggtagaaaagaaatggtatgtagagcttagatttccctattgtgacagagccatggtgtgtttgtaataataaaaccaaagaaccgt

SEQ ID NO: 47072 - DNA, 560 bp, Homo sapiens
tggaaaaattccgcctggaacaaaaagtttacttcaaagggctatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtcatttcaagaatttgggttttttggagggaggaggaaactgtttacttttttcctccacacgtttgatttttgacacatacacccctaattccctcaacagcagaacctacctgcagccccaggggaccagctctgtgtaggtaaccagatggctctttttccaagccaccatcttccagctgaccagactaaactcccaaccccagaccagggcaggggacaggctcaagtccttcccagcatacacacagggaacatacccataccacaaaccggttactgtcctgtcaccttcttgtctc

SEQ ID NO: 47073 - DNA, 312 bp, Homo sapiens
aagggttacattttatttaaatagcctccagtaagaagagagtgggccaattactaccccttccttgtaaaatgaagtaaccaagccaaggagggtaagtgcacccagcagccagccagccatgtgatgggtggggtgcctctcagtgggggcggccacgaccacggccccggcctgctgctgtgggagcatccacagtcgagcgggggttcttgatggtttcatctacagacacgatcaggcacgcagcctcagaggctgctgtcagcgcattgatccgcaccatagctggctcccacacgaaagcttaaa

SEQ ID NO: 47074 - DNA, 535 bp, Homo sapiens
ctcttaattaatatctgtatcctggaacaatattttatggttatgtttttctgtgtgtcagctttcagagtatgcatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttggctggttaaaaaatagggggagatattgaggccaagaatattgcaaaatacatgaagctcatgcacttaaagaagtattttaggaataagaatttgcatacttacctaggggaaacttttcctaggaa

SEQ ID NO: 47075 - DNA, 247 bp, Homo sapiens
tgaagcatatagcttcatcctacaagcctaaacagttgactgtccccagcaggagtacagggtaactacggacatgcggaaaaatatagccaagaaatcatgtccatatcataaccctgaataatagagaaaggtgcattgtgcaaaaatgagaggcccaaaccatagaaccctatacaagatgtacaaggaacaacccatgagaaagatggctatgcagctgaaaataaaacgacgtcgcatgact

SEQ ID NO: 47076 - DNA, 173 bp, Homo sapiens
tacgatgaaatagtatcatcatgtttttaagccttggaacgagtataaataatggctgttcagcagagaaacccatgtcctctctccatagggcctgttttactatgatgtaaaaattaggtcatgtacattttcatattagactttttgttaaataaacttttgtaatagcc

SEQ ID NO: 47077 - DNA, 350 bp, Homo sapiens
aaataatattaaaatgttttattttattaatgggtggagtagtgtaatacaaatgttttagacttgaagttctgtcagtgtttttatcattatatgactgtcaaagagctcataatagaattaagagaatgtgttggatatttccagcaccagtgttagatttggtaattcacaaggtgcgctcacaggactcagtgtattgtattagtcatgtttacggctgcgatttattacaagaggataggaagcattatcagcaaaaggaaaagatcattgggtaaagtctggaggaaaccaggtgcaaatttctcccggtagagttacacaagacacacataattcccctaccc

SEQ ID NO: 47078 - DNA, 271 bp, Homo sapiens
gaaggaaactaacatttactaatcctgtgccacgttgacttgcactctcaccttagaagctttgacctgtggaagcagctgttttccttaaagaatagcggtaacaacaatcatagtaatatatacaacttgtataatatgaaattcaaacagtagaaaaacaaaagttacattcttaaaataaatgtccctcttagtgactgactataggaacacctagaattggctcttgagaaatagagatagttgtaaaaaccaaaaaaaaaaaaaa

SEQ ID NO: 47079 - DNA, 220 bp, Homo sapiens
cgacagatgaggacagatgctacacataagaaaatgctgacatttttggacacatagggttgtaacacccgtccaacgggccttgttttgtaagtgttgtatgtaccgcatgatgttgataaaaagaaagtttatatcttgattatatatgttgctaaagctaaacaaaactcgcatgcagcagcctctgactgtttccagagtgcttataatatacata

SEQ ID NO: 47080 - DNA, 244 bp, Homo sapiens
tttctaccattcacgaattcccaagaagcaaaggaaaagaactattgtggaagaactgctggctgattctgaattcagaagatacaaccgaaggaagtactcagagatcatggctggaaaagcagcaaatgcagcaggaaaaaaagttccgaaagaagaagaaatttcgcaattaagatttaccaagcaaactgcaacattttacattgctcctttatttacttattaaagacgtttggaaaac

SEQ ID NO: 47081 - DNA, 256 bp, Homo sapiens
tgtaagatgatagctgtccttaagtctgctacgatgtctatctttattgtgggcctgactggcatgacagctgatgagtaatgatgtttactgcctatgaactattggcttataaaagccatagcattaggagaaaaacctaatgtaggtgacgggttgacgggtgcagcaaaccaccatggcacttgtatacctatgtaacaaaactgcacattctgcacatgtaccccagaacttaaagtataataataatttt

SEQ ID NO: 47082 - DNA, 249 bp, Homo sapiens
gaatggaaaataagatgggcccgcggccgcaataaaagttctctctcgagtatgtctataaagctttttagcgagggagtcacgacctgcccggagcaaaggaagaagtgcaaaggtgagatctcagctaactacaacctaacaccggccggggtcacgccatgcttacggcaacaccctaccaagtcgctgggaatacaggcgcctgccagcacacccggcaattagccgtgtaaccttagcagagac

SEQ ID NO: 47083 - DNA, 306 bp, Homo sapiens
gatatgtcatttaagtaaagttactgttcaacttagtttcaatgagttttaatagcgtcccagtgctacattttatttttcaagcttgtactcacggtttagttttttctagttgttagtgattgcaattatcaggatgagcctccttttagcagagtgaacccctttttaaaggccactttaacaacaaccaccaatatattgtttagagacggtttctgtctagtgtaaaacttgagtggctgactctaataaatggttttgaaatgtgtgactggtattataaaatttgtgaataaaacatat

SEQ ID NO: 47084 - DNA, 430 bp, Homo sapiens
actacacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcgccccaattaagaaagcgttcaagctcaacacccactacctaaaaaatcccaaacatttactgactcctcacacccc

SEQ ID NO: 47085 - DNA, 581 bp, Homo sapiens
tgcccagtgacacatgtttaacggccgcggtgccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaaatttcggttggggcgacctcggagcagaacccaacctccgagcagtacatgctaagacttcaccagtcaaagcgaactactatactcaattgatccaataacttgaccaacggaacaagttaccctagggataacaggcgcaatcctattctagagtccatatcaacaatagggtttacgacctcgatgttggatcaaggacatcccaatggtgcagccgctattaaagggctcgttggtcaacgattaaagtcctacgtgatctgagtcagaccggagtaatccaggcggttctatctacttcaaattcctcctgtaca

SEQ ID NO: 47086 - DNA, 138 bp, Homo sapiens
tatagcttagggcctggtggctaggccggatctctgcttttgagtcggagacccgagcggcaaacgtgctggggcagatcataaggcgggccaaggagcaccccaacgcaggacccgctcttggaacccatcgaggcc

SEQ ID NO: 47087 - DNA, 484 bp, Homo sapiens
ggctgcacattgcctgttctgcttcgaagtattcaataccgctcagtattttaaatgaagtgattctaagattgggttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcacttttttccaaatgatcctagtaattgcctagaaatatctttctcttacctgttatttatcaatttttcccagtatttttatacggaaaaaattgtattgaaaacacttagtatgcagttgataagaggaatttggataattatggtgggtgattattttttatactgtatgtgccaaagcttactactgtggaagacaactgtttaataaaagatttccttccc

SEQ ID NO: 47088 - DNA, 330 bp, Homo sapiens
agtggtcaccagggggacaggaagccccacaccaatgaatcactgggtgacgcgatgacgccttccgcccttggggagcgaatgggtaacccataggggacgaaggcctccctcgcgtgagccatgagaaagggactccaagaaacacgaagaaggccagtcctaggtggagagcaaaaaatcatcccaaattcactgatgtgaaggggggactgcctgcccgggggggtggaaaccaccctagtgctggaatgctctggcgcatcatacatcgctgacggggccataagccttggataatgcatatatgacgccgggaacagaaataaa

SEQ ID NO: 47089 - DNA, 440 bp, Homo sapiens
aaggaattcttgagataccatgaaacattcctaagtggtatcatattcatagagtggaactatcattagaagcatttggaaatgtttggtatttcacctcaagtgtaatcataatggtaaagattcttaatattggtgactaaagtaggatacatgtgggtttatattttcaggtagaatactggcagctacagtatgtcaactggagcatatttcaccaaatgccttgacaaagatggaatgacaatgaaattgctagatctcttctctggggcaggttatgcttttcaacttgcccctactaaggagagtaccagaagccatttgcccatgagtaataccttattaaaccatcatgatttaatgtggcatatttttctctcaatttgcatgcctgcagcgacttcctgaatatcacattcgagctgagccacagaaga

SEQ ID NO: 47090 - DNA, 437 bp, Homo sapiens
gcgaatatacttcctcttctttttgcatcgctatgcacacctcttctatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaactacaccaggttgctaactgtatttgtacatttccctttgcattcgcttttgtcttgctagaaacccagtgtagcccagggcagatgcaataaatgcatactctgtatttcg

SEQ ID NO: 47091 - DNA, 479 bp, Homo sapiens
accatgttgggcaggctggtctcaaactcctgacctcaggttatccacccgcctcggccttccaaagttctgggattacaggcgtgagccaccgtgcctggcccctctgtggttactttctctggtgaagtcaaacccctcaaagtcatccatgatgattggagccaacttttttcaaactcctctaaatgttgacatattgacctcttctcaatgaatcactaatgttcctaatggcatctaggatggttaatcctttccaaaaggttttcagtttactttattcagatctatctgaagaattactttttgtagaagctacagccttgcaaaaagtatttctgaaataataaaacttgaaagcagttggcatggtggccacacctgtaatcaaagcagtttgggaagccgagatgagcagatcacttgagtccaggaggtggagactagcccggcaacatagcaagttcccatctctt

SEQ ID NO: 47092 - DNA, 520 bp, Homo sapiens
ctgaagcacagtgtattcagacagatacagtgaaccaagtgctttatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacatttttttctttatgtgtagtgttttcatgctaccttggtaggaaacttatttacaaaccatattaaaaggctaatttaaatataaataatataaagtgctctgaataaagcagaaatatattacagtcattccacagaaagcatccaaacccccaaatgaccaaggcatatatagtatttggaggaatcaggggtttggaaggagtagggaggagaatgaaggaaaatgcaaccagcatgattatagtgggtcatttagataaaagtagaaggcacaggagaggtagcaaaggccagctttcttggtttcttcaaacat

SEQ ID NO: 47093 - DNA, 347 bp, Homo sapiens
aaggaggaaatggctcgccaccttcgggaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcccaaaaaaaaaaaaaaaaaaaaaaa

SEQ ID NO: 47094 - DNA, 798 bp, Homo sapiens
  misc_feature 1, 9, 17, 18, 23, 47, 52, 54, 65, 66, 67, 76, 78, 80, 82,85, 90, 92, 94, 95, 96, 103, 110, 113, 116, 118, 119, 129,134, 140, 147, 151, 154, 174, 179, 195, 207, 209, 211, 214,218, 227, 228, 230, 237, 247, 248, 250, 251, 260, 262: n = A,T,C or G
  misc_feature 268, 277, 282, 283, 285, 287, 289, 293, 300, 302, 305, 312,318, 357, 362, 363, 368, 382, 385, 396, 397, 400, 411, 415,420, 429, 430, 434, 436, 444, 449, 451, 456, 458, 462, 463,466, 467, 472, 476, 478, 480, 482, 490, 500, 507, 511: n = A,T,C or G
  misc_feature 520, 521, 522, 523, 525, 529, 531, 534, 541, 545, 546, 547,549, 550, 551, 559, 565, 591, 596, 600, 607, 612, 615, 623,625, 628, 631, 645, 649, 653, 662, 663, 664, 665, 669, 670,675, 677, 692, 694, 701, 702, 703, 704, 705, 707, 712: n = A,T,C or G
  misc_feature 715, 716, 717, 718, 720, 721, 727, 740, 746, 756, 759, 764,767, 771, 772, 778, 780, 781, 782, 783, 784, 790, 796: n = A,T,C or G
ngggggggncggacgcnncttangtagagacttcggccttacttggnggaantntcccttgagannnaggagacangntncntantattngnannnccacccntttctgnctnggntnncgctaagcancgatntatgangttccantctntgnatgttgagcctatgtgcccntaganctgacaagtgagtgtnttgtaaacagcntntngcngggnttgagactnncntataacncagcttgtgnnannttcgcgacngntcagcngcgctctgngatanngncnantaantgatgancnganttgtacngagaanctaccagtattaagcagtggctataaactgtgggcgagngtgannaggantatgcgcggcgtgngtntgctgaaactnnctnacaccgcgagntttngagtntgcgggggnngcananacacatgnatgangntgtgngnctgnnagnnatcgnaccnananancactctcngtcggatggngttcacnggantcgagaaannnngnctcnanatnggttaanggtnnnannngggggccntggatnacgggaagaggggggggcgagggccnaacanaggnggaaggnttggnttnactggaananagngcncctccccccgggtngttnggcncgggggggnnnntatnngagangnaaaaaacatttggcntnaaggaannnnngngggcncgnnnntnnttttgntaaaagagagggnaaaatnttttttttanaancaagnccnccanngggggncnnnnnccccanaaaaanat

SEQ ID NO: 47095 - DNA, 226 bp, Homo sapiens
gcaaacgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccaaaaaaaaaaaaaaaaaaaaaaaa

SEQ ID NO: 47096 - DNA, 267 bp, Homo sapiens
tggagagatgacagcagacccagcaaagagttctacttactttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttgggttgggatcaataggaaggcatatgcagccaaccaagatgcaaatg

SEQ ID NO: 47097 - DNA, 399 bp, Homo sapiens
acatttggaagactctttcaaattataactgttgttacatgtttgcaggttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggcattttcagacaccatttttctatatgttttgggcattttggtttgctctgatataggatatataa

SEQ ID NO: 47098 - DNA, 229 bp, Homo sapiens
gatggttcttaagggttcggtaagctctgaaaaatcaaggtttattatgatgctctacctgaacttggacatatttgactatagttagttcttcagtatttcttcagcggtcaccagagttataattgagtttgataattcttaagattttaggaaagctgaaattattcttcctactactacccttttgaataaacttgttctctaatcaaaaaaaaaaaaaaaaaaa

SEQ ID NO: 47099 - DNA, 370 bp, Homo sapiens
gcggaggctttggcagctcggaactgagtgcattaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaag

SEQ ID NO: 47100 - DNA, 465 bp, Homo sapiens
cacggttgcggtagcgacggtagctctagccgggcctgagctgtgctagcacctcccccaggagaccgttgcagtcggccagcccccttctccacggtaaccatgtgcgaccgaaaggccgtgatcaaaaatgcggacacgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggtaaaagcatggactgtgccacacacccagtgatccatccaaaaacaaggactgcagcctaaattccaaataccagagactgaaatttcagccctgct

SEQ ID NO: 47101 - DNA, 450 bp, Homo sapiens
cactagaatctgcacttctaaaagccatagaccattttttgttgttgctgttgcttttatgtctacgtgtttaggagtgaaactcaatctcaaaaataaaacaacaacaacaacaaaaaaacaaataacaaaaaataaataaataaaaattttaaaaaataaaccatcagatcttgtgagacttattcactatcacgagaacagcacaggaaagacctgcccccatgattcaattatctcccaccaagtccctcccccaacatgtggaaattcaggatgagatttgggtggggggcacagccaggcccccaggctggtgagggacacacagtatcacatgcctttgtagattgtatagtaattatcatttacatcaataacctcttcaccccaaccacaggcagagaacttttccaacaacaaaaaaacaaattcataaaacaaatagca

SEQ ID NO: 47102 - DNA, 200 bp, Homo sapiens
cgtattcaaatgacctagtgatatgatgttgaaacggcgccagcacactgtacttgtgaatacggtgtgtattgcacagaagggagggattaactttctacaaagtaacctatgatttctaatttgctaatgtgcctatgaaaatgtgccaaatgagggaaaagaaacagtaaactatacgattcttgactgcgaaaaat

SEQ ID NO: 47103 - DNA, 272 bp, Homo sapiens
ctgatcaacacaaaggtatgctatgtagatcattaacctcaatttctagggtataatttctcaaacattaagcatattatcagtcatgtggattcaaacacagtataagaaaatcctcaaggctgggtgtgatggcttatgcctgtaatcccagctacttagcaggctgaggcaggagtattgtttgaacccaggaggcagagttgcagtgagccaagatcgtgccactactccagcctggcaaaatagcaagacccgccccccatctctac

SEQ ID NO: 47104 - DNA, 650 bp, Homo sapiens
ttgtttagggatgcatgggtgatgatacataaagaaaatcataggaatgaataatccaaataagagaatagtggttgcatctaggagtgtacggttcaaatgggcaggagctcacatagagatcctgaagttttgaaaaatgttctttcttgacctgggttaataggtaactggatgttaatcattatttttttaaaccacaagtgcattttggccatttttctgtgtaaaatacatttcataaaaatgtttaatgtacatgaatctgagataagatacaaatcaatccaaatctagttgtttaaaagaaatgagactcaaacagaactgcactgcacctggtttcatttttacatgacattttagaataaaaatttcaaactctaagctatcccttagatagcaaagaaaaaacaggttgtagtttgcaaatcattactgaaaaggattttctatggttttcaaatcattcagttgcaaaatcagtaagagaaaaatctccacttatttttactcaaaaaaatgaaaatcttagaatgatttaaataacataagcctgaggtcatgaagcatctcccagatgagagcttacgtgtgccaaaaaagattttaaggccaaaagcctggaggtctggataccttggcaaatt

SEQ ID NO: 47105 - DNA, 327 bp, Homo sapiens
cagagaaaagagtgccatctaccgaaactccacagtttccattgttaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactcaaaaaaaaaaa

SEQ ID NO: 47106 - DNA, 308 bp, Homo sapiens
tgcctgtattctccaggaaacttgtccttctggaaatcatattgaatgatatttctatatcgaagagaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggcaaaaaaaaaaaa

SEQ ID NO: 47107 - DNA, 428 bp, Homo sapiens
caatactgcttctcaggaagccttggccgctgcaggtgagcaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattgctatttaaaacttgtaatttttttaatttacaaaaatataaaatatgaagacataaacccagttgccatctgcgtgacaataaaacattaatgctaccc

SEQ ID NO: 47108 - DNA, 587 bp, Homo sapiens
acgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcatgcccaacagttaaaaacaaggattcaggaaatttttggatgggatctatgtctctgaaaaaggactgtcacaggctgatgaataagatctaagaagttacctgctacagaaagaagatgccagatgacacttaagacctacttgtggatatttaaaaggagcca

SEQ ID NO: 47109 - DNA, 541 bp, Homo sapiens
aagattagatagaaaaatacgtattgatttgccaaatgaacttgcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcgtgacagatgttggcttattgtaaaaataaaggtaaagaaaataatgtatgtattggtaatgatgtcattaaaagtatatgaataaaaatatgagtaacatcataaaaattagtaattcaacttttaaggatacagaagaaatttggatggtttggtaaaagttgcatttatttgcagcaaggttccaaaggggaaagtggttgaagccttttcatatttgct

SEQ ID NO: 47110 - DNA, 241 bp, Homo sapiens
gggtcccatttcagcatgagaacagactcaaatagaacggggagacttttcccccaacaaaaggaaagacagtcctatttgcactgtatcacccttgagatactactgttacagagattagaaccacattgagtggggttttctgtgtaaatcgaaggagaaaaagaccagattactgagattggggattgtaactctgacttgccaaacaaactgctgcctcattttgggtaaaaaaaaa

SEQ ID NO: 47111 - DNA, 413 bp, Homo sapiens
aggaaggaatcattgtatataaatcaaatcaagacaaataggtagtttcctaccatttactaactagttactgggtgccaagctatgtgccaggcactttacatgtattgatttaacacttaacagccacactatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggtttcatttttctttaagaagatgatagtgtgatttgaaacatatctgaatttcagaagaggggac

SEQ ID NO: 47112 - DNA, 147 bp, Homo sapiens
tagactctagacaagatattgtacataaaagaattctttagtctataaatagatacaaatgtctatcaactcaatcaagttgtaacttatattgaagacaatttgatacataataaaaaattatgacaatgaaaaaaaaaaaaaaaa

SEQ ID NO: 47113 - DNA, 470 bp, Homo sapiens
ggcaagaacatagcgccttactaaaggcggcaaaaaggaagccatgaagaaggtgtctgatgcattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgctgactaacttccatggcatggatcttacccgtgacaaaatgtgtccatggcaaaaaatggcagacaatgattgaagctcacgttgatgtcaagactaccgatggtacttgcttcgtctgtctgggtggtttactaaaaaacgcacaatcagatacggaagacctttatgctcagcaccacaggtccgcca

SEQ ID NO: 47114 - DNA, 160 bp, Homo sapiens
ctaaataaactgggtaggaattaaagctacccactgagagttcaggttatttttctgctccacgtggtggaaatttttgctacctggaaaaatttaaagggtaagacatgacatctaactagcttctgatgtttctcttccagtgcaaaaaaaaaaaaaa

SEQ ID NO: 47115 - DNA, 460 bp, Homo sapiens
atgaacttaatcccttcattaacaggagaaatgcaaataccttcataccccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctgcacctgattttgtatccccctgtagcagcattactgaaatacataggcttatatacaatgcttctttcctgtatattctcttgtctggctgcacccctttttcccgcccccagattgataagtaatgaaagtgcactgcagtgagggcaaaggagagcaacatatgtgattgtccataataaacttctggtg

SEQ ID NO: 47116 - DNA, 128 bp, Homo sapiens
accccactgactcgaatgattggcggcttaaatggtgtcttgaaataagaactgtgaagctttgcctctttcccaagattgtattgctataggtcctttcttcataaagtggatattaagcttctcca

SEQ ID NO: 47117 - DNA, 639 bp, Homo sapiens
  misc_feature 391: n = A,T,C or G
gcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctnctattaatgtggcgattgaccgaggcctggcttttgaacttgctatagccctgctatcaaagactcacaatgagaagtatacaatttccagtgcctcaatttgatgcaaatctgcaaaggaaaaatgtaattatatctagtgctggagaaaggccttaaaaataagagggcatatgacggggaaaactaggctggtggttgggctctctgaaagtgacgccaaggctggggtgtcaccaactggcgag

SEQ ID NO: 47118 - DNA, 400 bp, Homo sapiens
actacgagggctatgtggctgattgaagagtatgcaatgagcgattttaggtctgtttgtccgtaggcagatggagcttgttataattatgcctcatagggatagtacaaggaaggggtaggctatgtgttttgtcagggggttgagaatgagtgtgaggcgtattataccatagccgcctagttttaagggtactgcggcaagtactattgacccagcgatgggggcttcgacatggctttagggagtcataagtggagtccgtaaagaggtatctttactataaaagctattgtgtaagctagtcatattaagttgttggctcaggagtttgatagttcttgggcagtgagggtgagtagtagaatgtttagtgagcctagggtgttgtgagtgtaaa

SEQ ID NO: 47119 - DNA, 301 bp, Homo sapiens
aaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagtac

SEQ ID NO: 47120 - DNA, 570 bp, Homo sapiens
  misc_feature 504: n = A,T,C or G
gatgacatagcgtcttatctttataccttgacaaccataagataatatgtcagcgttggagaaagtgaccatgcaagccttaacggatgatatgggcagtgcagctggtaatatgctggtaaggaagatgggtggagaaggaggccttcagggcctggctaaataatgccctatatgaagctgtctacctcctactccttggtctattcctggtcacatgtactgattttccaaaacaaagaaattcccatcttacccaaattcttggagttgatgttgactgtggaattctaatgtgcttgctcttagggtatgactggttccctggtgctgctggacggactggtcccccaggaccctctgtaagtaaatcactgtaaacatgtcttcatttactctagccaaaaggcctgctctgataggaaactggtaagaaactctcatgaaaaccatcactaatatcactattactctctggctgaagcagctttctgaccattaagnatttcatcacaagtatatttataatatcaagttaagagctttattcatgtgaacaccagtcccttt

SEQ ID NO: 47121 - DNA, 130 bp, Homo sapiens
tatcagcatgagaacagacacaaatagaacagagagagcatttccccaacaacaggaaagacagaacctattagcggggcatcaccctcgagatactacagtaccagagattagaaccacatcgaggggg

SEQ ID NO: 47122 - DNA, 473 bp, Homo sapiens
gaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaaacctttattgctaattgatttaacctcagtccaaagaacagtctctatacttgccctcatttactgataggctgctctagttaccatttgattgtcttgactttcgtctcagttgaattgggaaaacatcaacaaaaacaaacccactgtgtcttaaaataaaatgtctgcatgtagtcaataaaggcttaagatgtgaaacaatg

SEQ ID NO: 47123 - DNA, 294 bp, Homo sapiens
gaacgtgtgtgtcctgagttctcatctgaaagctttcatatcggttgactgcagatttgatttgtatccactgtcaccagcactgctcacttaggactttctggatccggacccaggcagcgcacactggactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgctt

SEQ ID NO: 47124 - DNA, 350 bp, Homo sapiens
tctggctttgttagcaataactgaccttcagttaacccttctttaaggagcagggactcagcacagaagtcactggggacggggctgaaggagtgtccctcctctatgtgaaaagaaaattgcttcattctacattctgactttttaactgtccggctcacttccagttagtaacgaatgaaaagaataattttctacttggagatgaagagggcagaatccgcagctctcatcattgtgacgagacatgctgccctctgactggcatcattgccattaactaacttctgggcatcacgcagagtcacgaagcccagacttggagcaagggcaaccttggaggcagtcca

SEQ ID NO: 47125 - DNA, 249 bp, Homo sapiens
aggaaacagtacccgaagttctttttcttgtggcatttgtattattaaaacttggtgtgggggaggagcacaaaactccagcccactgaacctctgccaattaagatggtgttgggttaggttacatctggtactgtcctgggaaaatcatttttatagagatggccttccaagtggttttaaaatttactgaagtttttaggtcaattatgtatgttgactaaatttacaaataaacttgtttattca

SEQ ID NO: 47126 - DNA, 291 bp, Homo sapiens
cacatacaactaatttatttgaactatatgttgaagacatctaccagttcctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtc

SEQ ID NO: 47127 - DNA, 604 bp, Homo sapiens
catttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgtccaacagacagggcctagctttcatttgacacacagactacagccagaagcccatggagcagggatgtcacgtct

SEQ ID NO: 47128 - DNA, 201 bp, Homo sapiens
aagtaaaaagcgctatatctaaaaagactttatgatcagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaaaaaaaaaaaaaaaaaaaa

SEQ ID NO: 47129 - DNA, 254 bp, Homo sapiens
tcagggctgaaggaccatgcacattcacctacacaggtctggaggatggctgcaccgaaacacactggggaatggagcaaaacagtctttgaatatcgaacacgcaaggctgtgggactacctattgtagatattgcaccctatgacattggtggtcctgatcaagaatttggtgtggacgttggccctgtttgctttttataaaccaaaactctatctgaaatcccaacaaaaaaaaaaaaaaaaaaaaaaaa

SEQ ID NO: 47130 - DNA, 422 bp, Homo sapiens
aaaaccagagaaaaatgtttatacaaccctaagtcaataacctgaccttagaaaattgtgagagccaagttgacttcaggaactgaaacatcagcacaaagaagcaatcatcaaataattctgaacacaaatttaatattttttttttctgaatgagaaacatgagggaaattgtggagttagcctcctgtggtaaaggaattgaagaaaatataacaccttacaccctttttcatctggacattaaaagttctggctaactttggaatccattagagaaaaatcctggcaccagattcattacaattcaaatcgaagagttgtgaactgttatcccattgaaaagaccgagccttggatgtatgttatggatacataaaatgcccgcaagccattatctctccatgggaagctaagttata

SEQ ID NO: 47131 - DNA, 505 bp, Homo sapiens
gaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttgcagatagaggcaactcccaggccagtgagctttacttgccgtgtaaaaggaggaaaggggtggaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgacatgttcccatgtaggaggtaaaaccaattctggaagtgtctatgaacttccataaataacttaatttagtataatgatgg

SEQ ID NO: 47132 - DNA, 452 bp, Homo sapiens
ctcgcagctaatttccgatgttcgcaatgccgcctaaggactaaggagattattatggacgctggaaagtcaggtcaataaagacaaagacccagtgaacaaatccgggggcaaggccaaaaagaagaagtggtccaaaggcaaagttcgggacaagctcaataacttagtcttgtctgcagaagctacctatgataaactctgtaaggaagttcccaactataaacttataaccccagctgtggtctctgagagactgacgattcgaggctccctgccagggcagcccttcaggagctccttagtaaaggacttatcaaactggtttcaaagcacagagctcaagtaatttacaccagaaatccaagggtggagatgctccagctgctggtgaagatgcatgaataggtccaaccagctgacatttggaaaaataaaactttattaaatca

SEQ ID NO: 47133 - DNA, 366 bp, Homo sapiens
ggggctcatgcttactgtaggtagagaatttttttgcatgctgggtacaggtggctaacatctggggatgccagtactttgggggcagaggcaggaggattacttgagctcaagatgtctgagaccaacactggacaacatgtctagaacaccatctctacaaaaaatgcaaaaattgaatggacatgacaggagccgtgcctgtggtcccggctgctcgggtggctggggtgagaggattgcttgagcccagaaggaaaggctgcggtgagctgtgattgtgccactgcacttcagcctgtgagacaggagtgagaccctatctcataaaacaccctcctgaaacgatgctttggatgttgcctt

SEQ ID NO: 47134 - DNA, 540 bp, Homo sapiens
tggtggccactgcgcagaccagacttcgctcgtactcgttttcctcgcttcgcttttcctccgcaaccatgtgtgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagaatgccgg

SEQ ID NO: 47135 - DNA, 586 bp, Homo sapiens
agatgcagggtaccccaaaccaattttcaaaggatttggaggttctaactggacaaatagtggcagcgctttcaacggctaaatataagaactggcctgaatctgtgtattttttcaagagaggtggcagcattcagcagtatatttataaacaggaacctgtacagaagtgccctggaagacggcctgctctaaattatccagtgtatggagaaacgacacaggttaggagacgtcgctctgaacgtgctataggaccttctcagacacacaccatcagaattcaatattcacctgccagactggcttatcaagacaaaggtgccttcataatgaagttaaagtgagtatactgtggagaggacttccaaatgtggttacctcagctatatcactgcccaacatcagaaaacctgacggctatgattactatgcctttctaaagatcaatactataacattgatgtgcctagtagaacagcaagagcaattactactcgttctgggcagaccttatccaaagtctgggacactgtccttagactgagagcaaaggaggagtcactaatgaagaaatgaataataa

SEQ ID NO: 47136 - DNA, 325 bp, Homo sapiens
aaacacttctgctttcacttaagtgtctggtccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccgc

SEQ ID NO: 47137 - DNA, 470 bp, Homo sapiens
aaaaaataaaaattccattaaggagtgggcaaagaacatgagcgaacagttctcaaaataagacatacaaatcatcaacaggtacatgaaaaaatgctcaacattgctaatcatcagagaaacacaaatcaaacccacaatgagatatcatctcacctcagttaagatttctattaccaaaaagacagaaaataacagatgctggtgagagtgcagagagaagagaattcttatacactgttggtggaaatgtaaactagtgcagccattatggaaaacggtattgagatttctcataaaactaaaatagaactactatatgatccagcaatcccactactggatatttatccaaaggaaaagaaatcaccatgtcaaagagatatttgtacttgggtgtttatcgcagcactgttcacaatagccaagatgtggaatcaacctatgtgccatcaacaaatgaacggaaa

SEQ ID NO: 47138 - DNA, 527 bp, Homo sapiens
gctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgacagcgctgccatatttgaaatcatatattaagactttccaaagatgaggccctggttttcatggcaacttgatcaggaaaggatttcacctctggttggaactaaaaccatctactatatgttagacatgacattc

SEQ ID NO: 47139 - DNA, 374 bp, Homo sapiens
ttaagtaagttttgttctccactgaagtaatacttaacatctcagaaaaaattttgcgtgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtagggccttttattcattgatatcttttcccaagtactggattttaaatctgtatgtatctg

SEQ ID NO: 47140 - DNA, 530 bp, Homo sapiens
aatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggttaattgcaggtgccagtttgctgatggccgccaaagttggagttcgtatgttgatgacatctgattagcagaagtcatgttccagcttggactcatgaaggattaaaaatctgcatcttccactatttcaatg

SEQ ID NO: 47141 - DNA, 420 bp, Homo sapiens
cgcatactattaacatcacgtagctgattctgccgcagctagaaatgctcaagaaccagctggaccagatgtatgtccctgggaagctgcatgatgtggaacacgtgctcatcgatgtgggaactgggtactatgtagagaagacagctgaggatgccatggacttcttcaagaggaagatagattttctaaccaagcagatggagaaaatccaaccagctcttcaggagaagcacgccatgaaacaggccgtcatggaaatgatgaagcaagaagattcagcagctcacagccctgggggcagctcaagctactgctaaggcctgagagtttttgcagaatgggacagagggacccctttgggcgcgcttcctgtgatgggaagggtcttgtgtttaatgccaataatgtgccactggg

SEQ ID NO: 47142 - DNA, 548 bp, Homo sapiens
tgaagctgacagcattcgggccgagatgtctcgctccgtgttcttagctgtgctcgcgctactctctctttctggtctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaactatgtgactttgcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatggaggggtataataatggtaacatggacatgatcttctttataattccactt

SEQ ID NO: 47143 - DNA, 148 bp, Homo sapiens
cgaaataatccttacctgttcctcctccggagggcaaaatttaacatgacgaagggagacgcatgaaacgtgattaacgtctctgcgtaatcaggacttgcaacaccctgattgctcctgtctgattcttaaaaaaaaaaaaaaaaaa

SEQ ID NO: 47144 - DNA, 642 bp, Homo sapiens
agaggtcaggagaggagagggacattattttatgactccctctaactttaacaaagactagtgcagattatattcgaagtaagcatgagatatattaaaaaccacatgtgggaattctttcctaattttagaggttttttttaaataatggaaattctattgaaattgagtagtgttaattacaaggcaacaggtaaacatttgttcaggatatttaaaaggtctgctgagttggaattgtgacagaccacattgttgactctagattgaattggaagggaagaatgtgaaatgaattaggatatcctctgttcacctctattaactttcttaaatgagtataacttagaaataataaaatgcaagtattttaacgttatagttgggagagttttgacaaatgtaaacacccacttcaccaccactaccatcctgatatagtgtggtccatcacccaaaaagttctctaaagcccttttgcagttggtcccctcccctgaacagccatccctagcaactacttttctgctttctgtggctatacgttagattgactcagaattctagagttgaaataaataggccatataatatgcactctttttggggctgactttttttgcttaacatgagcttttgaaa

SEQ ID NO: 47145 - DNA, 253 bp, Homo sapiens
ggcaaagggaagcttctcccgtttttcatatacataagtaagatgtcctctttcccaggtttgcacaatcacttctggcaaattaattgaaggtccttgaattcagccagtgcacgaaacctttgcatgttcttctgaaactgtacttcttccctattctgtctacccacactctgcgaactttgccttttccttaaacacattccagaccaaacactgttcagtttgttaaaaaaaaaaaaaaaaaaaaaaa

SEQ ID NO: 47146 - DNA, 453 bp, Homo sapiens
ttaaaaagaaaagtgtaatgcatgaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaaaaaaaa

SEQ ID NO: 47147 - DNA, 467 bp, Homo sapiens
aacggagagcgtaagtgaccatcatgagcctcctcttctagcccaagagtgagatgaccccagaggagctgcagaagcgagaggaggaggaatttaacaccggtccactctctgtgctcacacagtcagtcaagagcaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcaagtcatcgtggtcctgcggaacccgtcatcgccggcaagtagggccgcctgtctgttgacagactcactcctctgtcctatgaagaccgctgcattggtgttgagaataataaagctctgggttttttc

SEQ ID NO: 47148 - DNA, 534 bp, Homo sapiens
acatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaaattatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttacttggtttgccttaagcattacttttttaactttgtgccatttggtctttactttttatggatgtttcaaagaaactattttatattcaatctagtttatttagtctactgtatttctatttcgtggaagccttttcccctcaaataatatattatatcattttgggcttatataaatgataattaaataaattttttctta

SEQ ID NO: 47149 - DNA, 383 bp, Homo sapiens
cagggaaggacatggatgagaaggcccgaatcattcctattacatttgctaacactctattgagaaaatgaccatgaattaatggactcatcttaattccttctaagtccatatatagatagatatctatctgtacagatttctatttatccatagataggtatctatacatacacatctcaagtgcatctattcccactctcattaatccatcatgttcctaaatttttgcaatcttactgtaaaaaaaagtgcactgggctccagagaggcaatgttggagacttgagcaatgtgtctgcggccaagacccgtggccctttgtgctatggaagattttgtgggcgccctcttaggagaccattgggcattggccccacact

SEQ ID NO: 47150 - DNA, 440 bp, Homo sapiens
caaatagcgccgcctacatggatcaggccagcgaaaatggaatgaaggccctgaagccgacggggacaaatgaaggggaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggcctgatcaagaatttggtgtggaccgttggccctgtttgctttttataaaccaaactctatctgaaatcccaacaaaaaaaatttaactccatatgtgtcctcttgttctaatcttgcaaccagtgcaagtgaccgcaaaattccaggtatttatttccaaaatgttggaaacagtataatttgacaaagaaaaatgatcttct

SEQ ID NO: 47151 - DNA, 223 bp, Homo sapiens
atgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaa

SEQ ID NO: 47152 - DNA, 468 bp, Homo sapiens
gggcgcctagatatagtaccgcaagggaaagatgaaaaattataaccaagcataatatagcaaggactagcccctatacctctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggcactaggaaaaaaccttgtagagagagtaaaaaatttaacacccatagtaggcctaaaagcagccaccaattaagaaagcgttcaagctcaacacccactgctaaaaaatccca

SEQ ID NO: 47153 - DNA, 478 bp, Homo sapiens
gagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacatggcttcgattaacatgctgaggattgtagagccatatattgcatgggggtaccccaatctgaagtcagtaaatgaactaatctacaagcgtggttatggcaaaatcaataagaagcgaattgctttgacagataacgctttgatgctcgatctcttgg

SEQ ID NO: 47154 - DNA, 513 bp, Homo sapiens
atatgttattaataaaaatagaaggagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggttatatactttttgcattgtaaatagtctttgttgtacattgtcagtgtaataaaaacagaatctttgtatatcaaaatcatgtagtttgtataaaatgtgggaaggattatttacagtgtgtg

SEQ ID NO: 47155 - DNA, 480 bp, Homo sapiens
gacgtcgctttgaacgtgctataggaccttctcaaacacactccatctgaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagcaactaatgaagaaatgaataataaattttgacactgaaaaacattttattaataaagaatattgacatgagtatccagtttatatataaaaatgtttttaaacttgacaatcattacactaaaacagatttgataatcttaagaa

SEQ ID NO: 47156 - DNA, 579 bp, Homo sapiens
tagagcacagggtctcagtctaagctatggaaaagctccccttatccaacagagtttaaaagtagcgcgtgggtttttgcgagtgctttgtttactaaggactttggggaggaaccatgctaagccatgaccaggtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtggtaatttacttttattaaaaaagtatagtatatataatacaaaacaataacccttctggggtttcttgtggcggttgaaatagtcccacatgtggcatcagaaaataagccattcctcataccaatataggatcagctccttgacctctgaggggcaggagtgcttcctggtgtggggaataagaatcccctcctgccttgtttcatggcagtgaaatgcctcttggcctgtccaaag

SEQ ID NO: 47157 - DNA, 110 bp, Homo sapiens
agcaaggagtcatcgtatataaatcaaatcaagacacaaaggttgactgctaccatttactaactagatactgtggggcaagctatgggccaggcactttacatgtattg

SEQ ID NO: 47158 - DNA, 209 bp, Homo sapiens
agagagccttcttgtgcaactccaaaataaaggcaatgattgactgctcccccactgccaacacaattttgagctaagcactcaaggtggatacttcacaccataaagctggaatcagcaacagccctatgggaaaccagacaaagcattgacttttaaatgtagactttaaaaataaactgtttccttctggaactacaattagaata

SEQ ID NO: 47159 - DNA, 202 bp, Homo sapiens
agttttctccatatgaaatgagactttaggacttgcctacagaggtgatgtggaaacccaatccttttgactccaagtcaaatgcctacaaagcctccctgagaattgggccttgagaattgtaactattcatattcttgttgggataatcactctttggcaatggcatcatggaatcaatctcataaatgaaatattaaaa

SEQ ID NO: 47160 - DNA, 101 bp, Homo sapiens
atgtaagactaattacaataaataactgtacgtgacatgttttacggggatgcaaggagggagtttacataggggggcaaattaactgcgaacctgagaca

SEQ ID NO: 47161 - DNA, 358 bp, Homo sapiens
gtggtaacccgagaatacaccatcaacattcacaagcgcatccttggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccatacccgaatccgtgtgcggcttgtccagaaaacgtaatgaggatgaagattcaccaaataagctatatactttggttacctatgtacctgttaccactttcaaaaatctacagacagtcaatgtggatgagaactaatcgctgatcgcagatcaaataaaggtataaaattg

SEQ ID NO: 47162 - DNA, 557 bp, Homo sapiens
tgatgcttcaaaaacgagaagcacctgttccaactatgactaaagtggccgttgatgagaataaagccaaagaattccttggcagcctgaagcgccagaagcggcagctgtgggaccggactcggccgaggtgcagcagtggtaccagcagtttctctacatgggctttgatgaagcgaaatttgaagatgacatcacctattggcttaacagagatcgaaatggcatgaatactatggcgattactaccaacgtcactatgatgaagactctgcaattggccccggagcccctacggctttaggcatggagccagcgtcaactacgatgactactaaccatgacttgccacacgctgtacaagaagcaaatagcgattctcttcatgtatctcctaatgccttacactacttgggttctgatttgctctatttcaagcagatcttttctacctactttgtgtgatcaaaaaagaagagttaaaacaacacatgtaaatgccttttgatatttcatgggaatgcctctcatttaaaaatagaaataaagcattttgg

SEQ ID NO: 47163 - DNA, 318 bp, Homo sapiens
gcatgaaatggatacttatatggaaattctgctcagatagaattacagtccgtcaaaacagattgtttgcaacggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttcca

SEQ ID NO: 47164 - DNA, 142 bp, Homo sapiens
ggaatatggtaaaagacactgaaatgtatgcttaaaaatggtgttattttgtgatgtataaattctactgtagaaataataataacaacaaaagtaataaagcaaggtgtctttccacatctccatgtccagtattttcatt

SEQ ID NO: 47165 - DNA, 519 bp, Homo sapiens
cccgagtgcactgaagatggcggctgctgtaggacggttgctctcgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttacttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttggcagacttaactaagcaga

SEQ ID NO: 47166 - DNA, 381 bp, Homo sapiens
gctacactccatgtatctttgtggaacctagactcatgtgactcgtgctatctgcattagagagagagaagacaacaaaatatgcactggttcttgaagctttggcccagaagtaaaatatgtcttttacctgttcacattgcattgggccagggcaattatcatggctgcaagtaacttcaaaaggatggggaagtgcgatcttggcatgtgtcagaagaaatgaaaacatttggtgaagagcattaatgactgtctttacaggaaaaaagcaatcaaatagacatgatttcttgtttcagtttcatcatttcctactgtgttacctaaactttctgagccccagtttcttattactaaaataaaataatgataaagatg

SEQ ID NO: 47167 - DNA, 102 bp, Homo sapiens
tgttaggaatctctttggaattgggagcacgatgactctgagtttgagctattaaagtacttcttacacattacaaaaaaaaaaaaaaaaaaaaaaaaaaaa

SEQ ID NO: 47168 - DNA, 278 bp, Homo sapiens
cacccgccgatgtagccaaatgcgcggtagcgaagcataggtagaggcgacaaacctaccgagcatggtgaaagctggtggccaagatagatcttagccaactccaactccgccccagaaccatctgaacccccttgtatatttaaccgtctgtccagagtggcccagctctttggacactaggaaaaaaccttggggagagagtaaaaaatttaacacccatagtaggcctaaaagcagccccaattaagaaagcgtcaagctcagcacccactgct

SEQ ID NO: 47169 - DNA, 424 bp, Homo sapiens
ccagaagagacctcacccgctttgtgaaatggccccgctatatcaggttgccgcggcagagagccatcctctatatgcggctgatagtgcctcctgcgattaaccagttcacccaggccctggaccgccaaacagctactcagctgcttaagctggcccacaagtcagaccagagacaaagcatcgagaagaagcagagactgttggcccggccgagaagaaggctgctggcaaaggggacgtcccaacgaagagaccacctgttcttcgagctggagttaacaccgtctccaccttggtggagaacaagacagctcagctggtggtgattgcacacgacgtggatcccatcgagctggttgtcttcttgcctgccctgtgtcgtaaaatgggggcccttactgcattatcaaagggaaaggca

SEQ ID NO: 47170 - DNA, 316 bp, Homo sapiens
tcattgagacacattacctgaatgagcaggcgaaagccatctaagaattgggtgaccacgcgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcttttaccttttctataagttgtaccaaaacatccacttaagttctttgatttgcaccattccttcaaataaagaaatttggtcccc

SEQ ID NO: 47171 - DNA, 200 bp, Homo sapiens
aacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcatccaaaaaaaaaaaaaaaaaaaa

SEQ ID NO: 47172 - DNA, 190 bp, Homo sapiens
gtgaataaaagatggacaaaccacttttcaataaacaaagcaaggccttggcatcaatgaagtaataaaaactgggacctgatctatgatacgcttttctctttcattacaccctagctgaaggacatccagttccccagctgtagttatgtatctgccttcaagtctctgacaaatgtgctggttagta

SEQ ID NO: 47173 - DNA, 480 bp, Homo sapiens
gccactgtcttcttttttttctcatatatctaaggatgatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgcctgtatttatcacaagtttctgttgaacagcttttcaagtatttggggagtttatcttgccatcctccccttctggtctctgcacccacctgtcccactgcagttccttccgtgctctgtgactttaagagaagaaggggggaggggcccggatttatgttggttggttttctccttagcagaggacttgatatttcaatttggaagaactaaagatgaataaactgggtttttttggtg

SEQ ID NO: 47174 - DNA, 534 bp, Homo sapiens
cgaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttccctcaaagcgtttattgagaaactcaaatgaatatactttttgaattactgtcatcaaaagtgtacggcttcctgtgctgcttgtgcaaatggaacctgccctctaaagcactttctttcctttacttgcatggttcatgtaagctgtgctggttagaaacaacatctcagacttac

SEQ ID NO: 47175 - DNA, 520 bp, Homo sapiens
gaatcagaatctgcatgttgacaaggtccccaggtggttcatttgtacattcaagtttacggtgctttgcttggatcccagcctgagtgttagttctttaaagagacctttcccaactggccaaatcttatcaagtcatgtgatggattcacccacacggtctgtgatacagaagggaaaagaagttgagacctattgatcagaagctgctcactttagagttttacctaagggtgatcctatcaaaagttctggattttgtagagaagcatacaaagtatgtgaatagtttgatttgagcacattgaaaaattgccagttttctttgctttaaccaatgtttgctttccctctggaaatcccttgttacaggtccttagttttagtttgccacattatgacacgatgggaataatgcacagcagtgatcctcagttggttggggtttcaatacataattgatccatggttgtggcatgcattgtagcatgtccaactagaatacctatctttcaattac

SEQ ID NO: 47176 - DNA, 224 bp, Homo sapiens
aaatttttgttagggattataaaatgcctgttaaaataaaaagacttatatttactcctttgtggagctgaattggtttcggtcagacagcaatgtcaaatgcaaatcaagaaaatacatttctgaggccaaggcaggagatttcttgaccccagaaatttgcaacaaccccaaggaacatagtgagactctgtctctgcaaaaaaaaaaaaaaaaaaaaaaaa

SEQ ID NO: 47177 - DNA, 653 bp, Homo sapiens
ggaaaacacatgagcagtaacaagttttaatcttgctcctcagtactaacatggactaatctgtgggagcagttattccagtatcacccagggtgcagccacaccaggactgtgttgaaggggttttttttcttttaaatgtaatacctcctcatcttttcttcttacacagtgctgagaacatttacattatagataagtagtacatggtggataacttctacttttaggaggactactctcttctgacagtcctagactggcttctacactaagacaccatgaaggagtatgtgctcctattattcctggctttgtgctctgcaaacccttctttagcccttcacacatcgcactgaagaatatgatgctgaaggatatggaagacacagatgatgatgatgatgatgatgatgatgatgatgatgatgatgatgatgaggacaactctctttttccaacaagagagccaagaagccatttttttccatttgactgtttccaatgtgtccatttggatgtcagtgctatcacgaggtggacattgctcagattagggttgacctcagcccaaccacattccattgatctcgatgcttgtcttcaaacaataaaataagggaaacaaagaaaatgatttaaaggacccctta

SEQ ID NO: 47178 - DNA, 188 bp, Homo sapiens
caaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggatcccacttagccatcttgcctggataaat

SEQ ID NO: 47179 - DNA, 356 bp, Homo sapiens
agtggtcaccaggcggacaggaagacagacgagccagagggacttgtaaaccgctagctcgttgcaccgtgagggcacaggagcagaaacatggaatgccagacgctggggatgcgtggacaagttgtgggactgcatgctactgactagagcttgtctcagtggatctagaacttcatcgccctctgatcgccgagcacctcggagacccaccttgctcataaacaaaatgcccatgttggtcctctgccctggacctgtgacattctggactatttctgtgtgtatgtgtggccgagtgtaacaaccatataataaatcacctcttccgctgttttagctgaagaattaaagcc

SEQ ID NO: 47180 - DNA, 335 bp, Homo sapiens
gaaactcatcctcttggaccatattgcttagaaaactctacaggtgatcataacataattttcttcgagacttctatataatatgtgtcacttaaaagttctacataacctttatttaaaaataaaccaccttcatagatgaaacaaactggcatttatgtcctatatggagaaaccagaatagtaaagcccttttgcagaagttatgcaagtgttaattgtatttatcatcggaaacgatcacctttgttttcctaattttgacaagaaagcacagctaagctgagtgatagaagcaagatagtcgagtaggagataccagtcttcactcccga

SEQ ID NO: 47181 - DNA, 281 bp, Homo sapiens
tggaatcctagcacattgcgaggccaaggcaggaggatcacttgaggtcaggagttcaaaatcagcctggccaacatggtgaatccccgtccctactaaaaatacaaaaaaattagccaggcatggtgtcacatacctgtaatcccagctaatcggggaggctgaggctggagaatttcttgaacctgggagagagggaggttgcagtgagccgagatcgcactactgcactccagcctgggcaacagagtgagactgtctcaaaaatataataataagag

SEQ ID NO: 47182 - DNA, 267 bp, Homo sapiens
ctaaaactatgaaaaacctgcctttgagaatacctggtataatccttaatgtaacttgattataaactggaaaataccataatatccttttgagtctaattaatgtttacacattttgcaagattaatattttcaatctttctataacttgcttaaacctctagccctatcttatcaaatttaacataatccctcatcccagggcaaaatttacattgccctgctttcttataatattttactgaaaaaaaaaaaaaaaaaaaaaaa

SEQ ID NO: 47183 - DNA, 435 bp, Homo sapiens
gagcttctcagactatccacctttgggtcgctttgctgttcgttgatatgagacagacagttgcggtgggtgtcatcaaagtagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgccaaaaatttgcacagtattttgagacccattaaaaaagtt

SEQ ID NO: 47184 - DNA, 440 bp, Homo sapiens
cctcctgaaacatgcttatgtggaagtaaaagcttttgtgacacattagctttatcctaagatctgacagtgggtcctgatgcagctttcatcaaatttcaaatttatacatttaaaaaaggaaatatcaaacagggaaaaaagcattcagtcactccatacctttgtcttcggtctggctgctgattaacgggctaagatgaactccctttttaattctatccatcatctcttcaactgcttgcctctttagatctgtgacttcttcagctgttcaaagaacacagacataaatcctcttatgttacaagaaaacagctacttcccatttttggtgacttggaaaaattacactatgcaattaatcacagcatttttcattcacaggtggcagaacactaaaaatttactaggtaacagctatcagggagcaccactta

SEQ ID NO: 47185 - DNA, 540 bp, Homo sapiens
actgtaatatttttaatcatcttaaagcatgatttgatatattcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttatttattccctgattcaaaaatctctgtgaaaacgtggagggtttcataaaatctgtacccgcagttaaatgatccgctattataagcctgaatgccaggaaaatggcaggctatataacattgccacttaactttaaggaatatttgggagatatcccttgggaagaccttgcttggaagacctggctctaacattctacaccaaatggtcttttcaaagacgtatggactggggcctctgaaaacacatttgttaactgatgcgcgacgcaaattaacgacagaaccgagcctattaagctagagttttgtttctatgggtcacttgaaataaacggaattc

SEQ ID NO: 47186 - DNA, 436 bp, Homo sapiens
acagagtgcacagcatatattggtggaaccgtggccacagggcttctgcttaaagaataaacgaaagcagtgtggggacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagggctcattctagatcacaaccttctagaaaactccaagataaaagggagag

SEQ ID NO: 47187 - DNA, 460 bp, Homo sapiens
  misc_feature 451: n = A,T,C or G
cctgctttacaattcatattctggagaagactattcagtgtgcacctacagatgatatattagtagaattactaaaggaatatacctgctgcagaaaacatgcttttaaattagatgattatggaatgaaaccacaccgatgagaggcctgctttcattaataaccttttccttcatttacaagattctcctgaattattttggaaactatgtacccaattcatggacacaggatgatggctgcactctttgtgaattcgatacagtcgacttgtctgcagtagatgtccatccaaacgtatcaataggtgtttttattgagcaaccaaccccttttctacctcggtttctggacatattggtgcactggattacccaaaagaagcacttaaactttttattcataacaaagaaggttatcatgaaaaggacatcaaggtattttttgatnaagctagcc

SEQ ID NO: 47188 - DNA, 206 bp, Homo sapiens
aaatttgcccacagaaccctctaaatccccttgtaaatttaactgttagtccaaagaggacagctctttggacactaggaaaaaaccttgtagagagagtaaaaaatttaacacccatagtaggcctaaaagcagccaccaattaagaaagcgttcaagctcaacacccactacctaaaaaatcccaaaaaaaaaaaaaaaaaaaa

SEQ ID NO: 47189 - DNA, 540 bp, Homo sapiens
tgaggatcaaatcttacggttacttgtcgcggactttgcttttaacccaaattcttcctgatagactgtattctcctactttacctagagcacattgcaggaataatatatatagtgaaaattaagtgcacacaaggaagagcacagtctctaaggcatttatgactataaaaagcattccgcaaatttggggcattgaagtgttctctgcttataaatttgacagttttgatttacttgatatgtttctcagtttttcttgcgagagttacagactctagtcaaatcgtaggcattccttttttgcttatggcttctttagttaaagatttgtttggaaaaactttaggaacttaatgtatatgttggtcacatcagcatagggcaagtttcttggagtagtctagattcattttatttattacaaagtttcaaacatcattcatgtatgctggactggtaataaattttatttaatgaatttggttggtgctcaaaaatgaggaaagccataaagttagccagaaggaataaggcaaa

SEQ ID NO: 47190 - DNA, 366 bp, Homo sapiens
gggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattactttttttttctgcaggtcagtaaaaggatttaagttgcactgacaaaaataccaaaataaaa

SEQ ID NO: 47191 - DNA, 303 bp, Homo sapiens
gagtattattgaattaaaaactgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtccaaaaaaaaaaa

SEQ ID NO: 47192 - DNA, 410 bp, Homo sapiens
agaagaagatgatgatgatgaataagttggttctagcgcagttttttttttcctggcctataaagcatttacccccctgtacacaactcactccttttaaagaaaaaaattgaaatgtaaggctgtgtaagatttgtttttaaactgtacagggtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggagttttttcatcttcagttgtctctgatgcagcttatacgaaataattgttgttctgtaactgaatccctctgtaattgaa

SEQ ID NO: 47193 - DNA, 464 bp, Homo sapiens
agtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgcagttttcatagtatccatattttattactgtttattacttccatgaattttaaaatctgagggaaatgttttgtaaacatttattttttttaaagaaaagatgaaaggcaggcctatttcatcacaaga

SEQ ID NO: 47194 - DNA, 422 bp, Homo sapiens
aaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaaaaaaaaaaaaaaaa

SEQ ID NO: 47195 - DNA, 518 bp, Homo sapiens
atatattagagcgcttggatttatgtatataaggatattttcagccccctacagatctgtgggactggtttgaatccttccttgatgatgaagaggacctagatgtgaaggctggtggaggctgtgtaatgaccattgtagaaatgctacgatcttttctcacaaaactggagtgggtttctaccttgtttccaagaattccagtccagttcaaatgaatattgatcaacagattaaaacccgcccagaaaaatcaagaaagatgggaaggaaggtgctgaggaaatagacagacatgttgacgcagacgttcaaggtctccaaggagatctctgagtccacggaggtcccaagaagtcaagaagtagaagtcatcatcgggagggccatgggtcttctagtttgacagagaattagaaagagagaaagaccgccgccgactagagcgtgaagcccaagaaagggagaaagaacggcgaagatccgaagtattgaccggtggtataacgcagcgcagc

SEQ ID NO: 47196 - DNA, 154 bp, Homo sapiens
accaatgtagtacatgtatgaaaatggtgtactgtatactttaacatgccccatactttgtattggagagtacaataatgtaaatcctaaaagcaccactattttagcataataaaagaaagccaaagagctccgaaaaaaaaaaaaaaaaaaa

SEQ ID NO: 47197 - DNA, 607 bp, Homo sapiens
  misc_feature 607: n = A,T,C or G
ctgcagcagcctcacttaaaaccctatgctacatgaagctctttttactaatataggagactggcgaaatatcagtgtactgtggttggggtcagagggaatgctttcataatactcagattcttactgacggccccattttcacttctgtgttctgtttttcttattagctttctcccatgacagagtcctgacttctgttcatatccactacctctggccctatgctttccatctgttttgtttgtaagcttatttctatacctgtaatggggaaatagatttagccccaaggccttaaaaaatactaatagcaagacctgcgagattaggaatctcctaatttgcatttacatatgggtacattgccatcataaatatttaattaatttacctttactataagatttttgtttacatggatagggacttactacctgtctcacacaagaatttttggtttatatgaaacctgtaggctggtcagcagacacatttttaatgggcccgctgatggaacaaacaagcaagcttggttgctattattaataataaccatccggcgtgggggctcacgcctggaatcccagcactttgggaggctaan

SEQ ID NO: 47198 - DNA, 350 bp, Homo sapiens
gtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttactaaaaaaaaaaa

SEQ ID NO: 47199 - DNA, 590 bp, Homo sapiens
ggaaccacctagttgtttaaaatgtttttagattactgatttatattaagatgacccacactgcaattagattatgcctaggggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgcttctttaaagccttgctttaatcatgggaaattgttgttgttgttgttgttgttgatcctatgttgggattctggatgtctgaccataatcattttagatatttgaatgatcctgtggattggaaggttggccatttgaccattatttattatcaagttggtgtatgctaaggtaagttgccccatagcattatacagtatctcattgctcttgaatgatatctgttatttaagcatgtttaataagtaaaagggttgaatgaaaacccttct

SEQ ID NO: 47200 - DNA, 193 bp, Homo sapiens
aaacttaaaaaaacagactcccatttcttaaaaacggataagcctgaaaggaaactgctattgaacttaagcatctctagcagagcaatttgatcagtatataaaaccctaggatgtgctaggtctaagatggattaaacaagtataaaataaaatacatttataaaaaaaaaaaaaaaaaaaaaaaaaaaaa

SEQ ID NO: 47201 - DNA, 116 bp, Homo sapiens
gaagcattcagcaaacaatggcaaggcagagccaccagaaacgtacacctgattttcatgacaaatacggtaatgctgtattagctagtggagccactaacagcaccgctacatgg

SEQ ID NO: 47202 - DNA, 573 bp, Homo sapiens
  misc_feature 2, 3, 4, 5, 6, 7, 8, 9, 10, 11, 12, 13, 15, 20, 23, 26, 27,28, 32, 39, 46, 47, 48, 53, 61, 459: n = A,T,C or G
gnnnnnnnnnnnnanaacgnatnccnnngganggcctcncggcctnnntgggnaaagggcncgcggaccggggaaagagggcgaggggaagagacgaatcggcctgcccagagcgcgccgcgaggccgcgagactacacttcaaaaagcatgaggaggcttgctttctacatgctgatttaatttcggaatacattcgaggccctgtgctaagttaggtgttatgatgctacaacttctggaaaaagtaattgaattggaaaattggacagaggggaaaggcctcattgtccgtggggcaaaaaaatactttctcttcaggatctgatctgaatgctgtgaaatcactaggaactccagaggatggaatggccgtatgcatgttcatgcaaaacaccttaacaagatttatgagacttcctttaataagtggtgcgctggtcaaggttgggcattgggnggaggagcagaatttactacagcatgtgattcagggtaatgactccagagagtaagatcagatcgtcccaaagagatgggcataataccaagctggggggcacccccggctggt

SEQ ID NO: 47203 - DNA, 415 bp, Homo sapiens
ttgacgctgccatgtaaccacaggctcacaattaaacaatgaagaagcagaaaaaaagaaaatgcctgagttaaaaaagccaccatgactatgagatagcagcaacatcaagctgcaggatcaggctgagaaagtctgaagatatttgtatcatcaggtacagcaaataaggtaagcatattttttaaaaattcaagattgaaagtatgttgaaccaaacaggacaccattaaaagtaataagacagatgtaaaaagcaaagaaaattcttagaaatggcttaagatgagaattagcggacaatggatatgaagaaattacctagcatacagtacaacaaagagatagaaatatgaaaaagatgttaagaggatagagtaagaaagcccaacaaacatttaatttatggtccaga

SEQ ID NO: 47204 - DNA, 424 bp, Homo sapiens
ggatggttgccatgtctgtgtaagaaagatgtagacgtgggattattttcattttgttctatactaagaaaaattgttctgccttgggatcctgttgatctgtgaccttacccccaaccctgtgctctctgaaacatgtgctgtgtccactcagggttaaatggattaagggcggtgcaagatgtgctttgttaaacagacgcttgaaggcagcatgctcgttaagagtcatcaccactccctaatctcaagtacccagggacacaaacactgcggaaggccgtggggtcctctgcctaggaaaaccagagacctttgttcacttgtttatctgctgaccttccctccactattgtcctgtgaccctgccaaatccccctctgcgagaaacacccaagaatgatcaataaaaaaaataataatc

SEQ ID NO: 47205 - DNA, 240 bp, Homo sapiens
gttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatg

SEQ ID NO: 47206 - DNA, 277 bp, Homo sapiens
gcactatcgttgcctaacgcagacatggctcgagtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgaaaaaaaaaaaaaaaaaaa

SEQ ID NO: 47207 - DNA, 476 bp, Homo sapiens
  misc_feature 349: n = A,T,C or G
gcgaacgggcaatgtcgctctgcatgtggaccaccaacgcttctccacctttgcaggggtcctgctctatgaaactaagtaaatatatgactagaacagctccactgtgggtaagacttgttgctgagctgatatggcacgatctgaggcacctttgagttgagggttttacattgctgtattcaaaaaattattggtgcaatgttgtcacgctacaggtacaccaataatgttggacaattcaggggctcagaagaatcaaccacaaaatagtcttctcagatgaccttgactaatatactcagcatctttatcactctttccttggcacctaaaagataattcttcntttgacgcaggtgggaaaaattttttttctatcacaagaagtcatttgcaaaagaattttgactgctctgctttaaatttaaataccagttttcaaggaaccccctgaaggtttaaagttcaatatt

SEQ ID NO: 47208 - DNA, 389 bp, Homo sapiens
aaatattttatataattttcattttttggctgagcaagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgctgattttaatgccgtcttagccaagctgctagcaggtgttaattgaatccctttccttcactgaaatggaagagttataagcttacgttagtattgtaatatgtaaagaagcccaac

SEQ ID NO: 47209 - DNA, 395 bp, Homo sapiens
taacttactaaaataaagatttttttctcttactgcaatttgaaaaaactccgccaccatcttaagtgtaggttggtttaaatctatttttgataaacaagactttaatgtgatagaccaaatggaggaaaattgaaaggcatttcagagattgaaatgtttttgtttccacttgcattaccttatgccaagatcagggctttggtttgacttaatattggaagcataaaagagaataaccagtctgcacatttctttgaaaaccactcttcatgtaacatacaaaactcataaaaatgggtactgtaaaaatagtgccttaataatacttcatgctaaccagctgattatagactgaatgcttagttaagtgggggaagaaataagtaggttcc

SEQ ID NO: 47210 - DNA, 300 bp, Homo sapiens
  misc_feature 297: n = A,T,C or G
agattacataatagtatttctagaaaaaagaagatattttagtattgatgccacttttggttaaaaacctggcctggggacaactggattaattttgggtttatcttggcatatatccttcaggttggttttatttttaatttttcctttttttccgattaggctttggcagcatttttcatttaaagaaaagtaacactcccatccactcataagcttggtacaaaaacctctctggcaggtacctttgaagcctcactctgcttctgtgtaaagggcagtctggggcacgccggncca

SEQ ID NO: 47211 - DNA, 492 bp, Homo sapiens
ccatggcacttattaccactcgagtcattatctgaatgttacctcagaaccctcgtgacataagattagagtacaattaaaatgattttcaacttggaataccaagtatcatatgatctccactctggctttctccaggtagtctctgttggatggaatataaccagaaaaataaatgttgggttagaaaaattgtcacaaggggctggccaggctctgtggctcacgcctgtaatcctggcactttgagaggccgaggcatgtggctcacctgaggtcaagagttcgagaccagcctggccaacatggtgaatccctgtctctactaaaaatacaaaaattagctgggcatggtggtgccgtgcctgtaattctaactactcaggagtctgagacagtagaattgcttgaacctgagaggcggagcttgcagtgagccgagtagatcgcccaactgcactccagcctgggagcaagactctgctcgaaagg

SEQ ID NO: 47212 - DNA, 489 bp, Homo sapiens
gagagcacggtctgaatcggcacagagcaagatgctgagtggtgtcgggggcctcggctgggcctgctctcaccggggggccgggctgttcatctactgcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgttctcaaagacaaaaaaaaaaaaaaaaaaaaaaaaaa

SEQ ID NO: 47213 - DNA, 520 bp, Homo sapiens
ataaaaagatctaaataaacagagagacatactatgttcatggttagtacttgacatagtaaagacacaatatactaagagatggcaattctccccaaatcaatatatacatttaatataattcctacccaaatctcagcaacgttgttttttttaaaatagatagaaagaggattattctaaaattttgactaaaggctgaggaaccataatagctagaacaatttttaaaacaaactaagtgggaggaatcagtctaccctatttgaagacttattatatagctgtagtaatcaaggctgtgtggtattgacagaagtacagacatagatcaaaggaatgcaataaagaattcagaaatagaccccacaaatacacctctgtgttgccttatttttcagaaaagctctagactcagagcaggaagcccaggtttaggccttggccttgcacaagtgagttcttccagttataaaactttgattttctgggtctaaatcacttaaacttttctatctca

SEQ ID NO: 47214 - DNA, 483 bp, Homo sapiens
aacagtgatggaaaacacatgagcagtaacaagttttaatctttctcctcagtactaacatggactaatctgtgggagcagtttattccagtatcacccagggtgcagccacaccaggactgtgttgaagggtgttttttttcttttaaatgtaatacctcctcatcctttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgcaaacccttctttagcccttcacacatcgcactgaagaatatgatgctgaaggatatggaagacacagatgatgatgatgatgatgatgatgatgatgatgatgatgaggacaactctctttttccaacaagagaccaagaagcca

SEQ ID NO: 47215 - DNA, 352 bp, Homo sapiens
gataatacataagaataaaatggaaagtacattgtgaacttcgatagacatgttcacagaataacttgttattacttggattaaaagtgcaatcctagttcatttgtttatatattttctaaaagttgatatagatctctgaattaaaatacttgtaatgatatttctgcttttatctgtattttatgttccaaaacttcacaaattatactgttaactaggtttgtataccataaagacaaatgttgaataaatagctgttctttcaatttctttaaaaaaaagatccaagatgggcattatattcattgtatgtttacaaattcttacattttagttattcttcagcaaa

SEQ ID NO: 47216 - DNA, 124 bp, Homo sapiens
aacgctcagtgacacgagaaaacaccctcgatgtgcatacagatatgcctggattctactcctatgcctcaaccccgacatcattaccgggttttcctcttaaaaaaaaaaaaaaaaaaaaaaa

SEQ ID NO: 47217 - DNA, 647 bp, Homo sapiens
gtaagcggtggtggttatgactttggttacgatggttacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctgcagccagtttgaatataatgtagaaggagtgacttccaaggaaatggctacccaacttgccttcatgcgcctgctggccaactatgcctctcagaacatcacctaccactgcaagaacagcattgcatacatggatgaaggagactggcaacctgaaaaaggctgcattctacagggctctaatgatgttgaacttgtgctgagggcaacaagcagggtcacttacactggtcttggagatggctgctct

SEQ ID NO: 47218 - DNA, 245 bp, Homo sapiens
acgtaacttaaatgaacatattaaatgtgtatcttttcttcatataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaaaaaaaaaaaaaaaaaaaaaaaaaaaaa

SEQ ID NO: 47219 - DNA, 558 bp, Homo sapiens
gctctgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttgcggaatatctctttgacaagcacaccctgggagacagtgataatgaaagctaagcctcggctaattccccatagccgtggggtgcttccctggtcaccaaggcagtcatgcatgtgggggttcctttacctttctataagtgtaccaaacatcacttaagtctttgatttgaccattcctcaaataaagaaattggaaccc

SEQ ID NO: 47220 - DNA, 352 bp, Homo sapiens
cttggaaagagactcgcacactgagtgatcatcggttgagcccaaagtgctaaaatacaggcgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggagcctctggagggtaaag

SEQ ID NO: 47221 - DNA, 520 bp, Homo sapiens
cgggccgagatgtctcagctccgtgtccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttggaagatgccgcatttggattggatgaattccaaatctgcttgcttgctttttaatattgatatgcttatacacttacactttatgcacaaaatgaagggtataataatggtaacatggacatgaacctcctt

SEQ ID NO: 47222 - DNA, 124 bp, Homo sapiens
gtaccatttcatgaccatcctttggaacatatatgcatttgctacaaaccattggttttgtttaaataaataaataagtaaataaagctagttctattgaaatgtgatacaaaaaaaaacaaaa

SEQ ID NO: 47223 - DNA, 378 bp, Homo sapiens
gataacaattgtgggcacggtgaagcccaatgcaaacagaatttttttagatttccaaagagggaatgatgttgccttgcactttaacccacgcttcaatgagaacaacaggagagtcattgtttgcgatacaaagctggataataactggggaagggaagaaagacagtcggattgcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagatt

SEQ ID NO: 47224 - DNA, 220 bp, Homo sapiens
ctaacaaaaagtccctgcgctccatgcagcattatccatagtgccctgatgaggggctgactgccttgagtggcccgatcgccacagcccttcttggaagaaaggcgtccgtgtttcaggttccacgcgagtcacctctttcgtcttaatgttcaccgtccacagctttggaataaaccatcctgggaagctaaaaaaaaaaaaaaaaaaaaaaaaaaaa

SEQ ID NO: 47225 - DNA, 500 bp, Homo sapiens
tgatccacatgcgtgtggcagcccaaggctttgttgtaggagctatgactgttggtatgggctattccatgatcgggaattctgggcaaaacctaagccttagaagaagagatgctgtcttggtcttgttggaggagcttgctttagttagatgtcttattattaaagttacctattattgttggaaataaactaatttgtatgggtttagatggaaacatggcattttgaatattgcttcctttcttgcaggcttgatttgcttggtgaccgaattactagtgactagtttactaactaggcattcaaggaagcaagttaacttaaacatgtcacctaaatgcacttgatggtgttgaaatgccaccttcttaaatttttaagatgaacttagtctaaagaagataacaggccaatcctgaaggactccctgtttgctgcagaatgcagatattttggatgttgcataagagtcctatttgccccagtaatcaactttg

SEQ ID NO: 47226 - DNA, 304 bp, Homo sapiens
aacaagagcacgcacatatacacgaatagacatcaaactcaatgcttgatttgtaaatttagtgtttttttatttctactgtcaaatgatgtgcaaaaccttttactgggctgcatggaaatcagccaagttttataatccttaaatcttaatgtcctcaaagcttggattaaatacatatggatgttactctcttgcccaaattatcttgatacatcaaatttgctggtaaaaaaataggtggtagatattggaggccaagaatattgcagaatacatgaagctttatgcacttaaaagaaag

SEQ ID NO: 47227 - DNA, 500 bp, Homo sapiens
acaggaaacaacctcggccaacctataaacgttttcattcttcattccaagagagagagaggaaagaaaaatacaaccttcattctttctttgcacgttcataaacattctacatacgtattctcttttgtctcttcatttataactgctgtgaattgtacatttctgtgttttttggaggtgcaagataaacttttaagcttaagtgtgacaggactgataaatagaagatcaagagtagatccgactttagaagtctactttgtgaccaaggagctcaatttttgttttgaagctttactaatctaccagagcattgtagatattttgttttacatctattggttaaaatagatgattataacggggcagagaactttcttttctctgcaagaatggtacatattgtatagataaatgagtgacatttcataccatgtatatatagaggaggtcctataaggggtgaagaaaagtaccatgcctttaataggaaacct

SEQ ID NO: 47228 - DNA, 191 bp, Homo sapiens
ttgtggaggagggcgatatgaaaggagaggtctatccttttggcaaccgggggacggccaacaaaggggaggggcccgcagaaaggggagagcgccaagcaccaatagcgtgccctgggccaaaagacacacactatggcccacaacatcacacccccgcgcaagcccacagtggaatgcgagaaagaaca

SEQ ID NO: 47229 - DNA, 474 bp, Homo sapiens
ctatattagtgctgcagaacttcgccatgtgatgacaaaccttggagagaagttaaagaggaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgcaaaaaaatatgcatgtatagtaattagggacttcattcctccatgttttcttcccttatcttactgcattgtcctaaaaccttattttagaaaattgacaagtacatgttgcatgtggcttactctggatatatctaagccctctgcacatctaaacttagatggagttgggcaaatgagggaccatctgggtatgcctttttaaagtagttttctttaggacct

SEQ ID NO: 47230 - DNA, 396 bp, Homo sapiens
aagcatcttactttaattatataaatgtatatactgtctttctcaactggggcttcaagagagaattaagcccaaaataaaataatttgtgtatcttattttctcatttttctctaggatgatacacagctaatacccttctagatgcatagaaaaagttaatttattatatacaatggataccttaaggcaagagttgcaaacttttcctgcaaaggaccagatagtaaatattttaggcttcgtgggcataaagtgtctattgtaactgtttaaccctaccttgtagcatgaaatacttaaacaaatgagtgtggctcaaataatataaaattttattcatagcactgaaaggtgaatttcagataactttaacatgtcacagaatctcttaaa

SEQ ID NO: 47231 - DNA, 629 bp, Homo sapiens
cgcgacgaaggagtaggtggttgggatctcacctttgggtccgattagccttttctctgccttgtggcttgagcttcagcggaattcgaaatggctggcggtaaggctggaaaggactccggaaaggccaagacaaaggcggtttcccgctcgcagagagccggcttgcatgttcccagtgggccgtattcatcgacacctaaaatctaggacgaccagtcatggacgtgtggtcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattcccacatcccaaatcttctgattgggaagaaaggacaacagaagactgctaaaggatgcctggatccttgttatctcaggactctaaatactctaacagctgtccagtgttggggattccaggggactgtatctttgggaaaaaacaattttgcctttttggaattctatttgacaaggtgggaagtttaattaactttccaacc

SEQ ID NO: 47232 - DNA, 414 bp, Homo sapiens
attcatttaaaacaacaataataaacctgttacatgttaacataacataaataacttttttttgagagagggtctggccatgttgcccaggctgatttcgaactcctgggctcaggtgatcttcccgcctcggcctcccaaagtgctgggattacaggtgtgagccacttcatttggcctaataacatatttttaatgaaaaataactattttccaaagcaaaataatttagtgagaagagtggcattattttacatttctgcaaatctcttcagtgtctgggctaatagaagattctcatatctgtgtctgcgttccatctgtatcacaggcatgtagtctctggaagacctcactgtattgttattagagtgaaaaaggcagtaagtcttagtatgaaaataaagtcttagc

SEQ ID NO: 47233 - DNA, 228 bp, Homo sapiens
gagcccggtattaaaggacaggttgttcgacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttaaaaaaaaaaaaaaa

SEQ ID NO: 47234 - DNA, 453 bp, Homo sapiens
tgtgctctttgtgaaattccaccatggcgtaccgtgtccagtttcagaaagcgcagaaggctatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatcagtttgtttttagatgcctttgccaatgtgaacatttattcatattgttttgattaccctcgtggtactacaagatgcaataaatactatgggattggttgtataaaaaaaaaa

SEQ ID NO: 47235 - DNA, 290 bp, Homo sapiens
ggaagggatgtgagatgatctgttactgcaacttcagcgtaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatc

SEQ ID NO: 47236 - DNA, 200 bp, Homo sapiens
actgacgtgtgtagtggaaagcagtgctcagcttatagctgtgactgcctgtattaaaaaaaaattcctaaaatcaataacctcactttacactttaagtcactggacaaagaagagcaactagaaaagcaagcaagcaagcagaaggaaggaaataatattagagtggagataggcaaccaaaaaaaaaaaaaaaaaaa

SEQ ID NO: 47237 - DNA, 500 bp, Homo sapiens
aaaaaattattggcggcaatgttgtccacgctacaggtacacctataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactgctctgcttttaatttaataccagttttcaggaacccctgaagttttaagttcattattctttataacatttgagagaatcagatgtagtgatatgacagggctggggcaagaacaggggcactagctgccttattagctaatttagtgccctccgtgtcagcttagcctttgccctttccttttgatccacaaaatacattaaaactctgaattcacatacaatgctattttaaagtcaatagatttagctataaagtgcttgccaggaatg

SEQ ID NO: 47238 - DNA, 335 bp, Homo sapiens
aaatagaattctcgctcgcaggagtggaaatgcctgaaccctgcacagagggctttatacagggccgtgatgttggagaactacaggaacctggagtctgtgggattgacttctaaggactcttggaacatgaggaagaaacccggaagggcaagagaaaagcaaaggcgcacgaatggttcttcctcagggtctattgacattcagggatgtggcatagaattctctcaggaggagtggaaatgcctggaccctgctcagaggactctatacagagatgtgatgttggagaattataggaacctggtctccctgggtgaaggataacttccctc

SEQ ID NO: 47239 - DNA, 222 bp, Homo sapiens
gaatcttagcccaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaaaaaaaaaaaaaa

SEQ ID NO: 47240 - DNA, 535 bp, Homo sapiens
taagtacttagcctcttctgacttctcaaaggacaatcggattcatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtggggctggaaacctgcaggaccacttctagaggacctttgcctaaactctttagaattgaggcccacttgatggcacatttaatacccaattcttccataatagatattttaatagcaggacagatggcctgattagacaagactatttggaagtg

SEQ ID NO: 47241 - DNA, 221 bp, Homo sapiens
atatgatgaaaggaaaaagaacgccataattagcagtctcctttaggagcagccccagcagggcaagcttcttcgtgcatcgcttcaaggccgggacagtgtggccgagcagatggctatgtgctagagggcaaagagttggagttctatcttaggaaaatcaaggcccgcaaaggcaaataaatccttgttttgtcttcaccccaaaaaaaaaaaaaaaa

SEQ ID NO: 47242 - DNA, 571 bp, Homo sapiens
agagagaacttgttggaaacatttttataactttagttaaaatcagaataaaaaacatgaaacccatttttaaatatttagtctacgtgaaacagttacacttccttcatgttacaggatcaacttcctcattgttcttgcaccaaaatatttctcagttccttttattgatattcagggattcgaacttcatatagtgtttccgcagaggatgtgtgtgtgcacatgtgtgttttaaattaaagcatacaactgcagtgttgtttggcccccgaagaatgtttacacgacatactcttcatttttttttcaaggcccgatctggttactgatcactaggtccttgtagaatcaaaacacttagaactaaaacagatttgctgttgagtcaggaggaaaatacatggcaagaagcagctccaatctgacaaaagcaggtgagatccttttaccaaggttagccctggggtttggcatctagtcaatgagggtgtgcatgcagcactccactagatgggaaactgctggacagaacttcaagactaggttttcctgttgctcccaaactttt

SEQ ID NO: 47243 - DNA, 430 bp, Homo sapiens
gcgcacagccacacaaagaagaagatccgttcgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggctgatggagagaagaaggcatatgttcgactggctcctgattacgatgctttggatgttgccaacaaaattgggatcatctaaactgagtccagctgctaattctgaatatatatatatatatatcttttcaccat

SEQ ID NO: 47244 - DNA, 649 bp, Homo sapiens
tgccagaaactcattgaagagctcgatgaacgctaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgctggccccaaaagagctagcagaatccgcaaacttttcaatctctctaaagaagatgatgtcccgccagtatgttgtaagaaagcccttaaataaagaaggtaagaaacctaggaccaaagccccaagattcagcgtcttgttactccacgtgtcctgcagcacaaaacggcggcgtattgctctgaagaagcagccgtaccaagaaaaataaagaagaggctgcagaatatcctaaacttttggccaagagaatgaaggaggctaaggagaaaccccaggaacaaa

SEQ ID NO: 47245 - DNA, 349 bp, Homo sapiens
actatgaggacttctaatacgttttggtgaagaagagtgtatttagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgcaccagaatgataagtgcaatagttgtaaatctacttgacactgtaataaactgaactgaacttccaaaaaaaaa

SEQ ID NO: 47246 - DNA, 510 bp, Homo sapiens
gcattagcttgaagcactacaggaggaatgcaccacggcagctttccgccaatttctctcagatttccacagaactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttcagagaggacctatcccaaatgtggaattgactgcctatgccaagccctggaaaaggagcttcagtattgtggggctcataaaacatgaatcaagcaatccagcctcatgggaagtcctggcacaatttttgtaaagcccttgcacagctggagaaatggcatcattataaagctatgaggtgaaatgttctgtcaaatgtgtctcacatctacacgtggcttggaggcttttatggggccctgtccag

SEQ ID NO: 47247 - DNA, 519 bp, Homo sapiens
ggcagttaagccacttctgtaagtgtttattagcattggcatgttggtagtagtcctgttcttcagaccatagctttgaaccagaatagtgctcttcatctccagagacaaacttccatgcactaacccagcagtaaaggatttggcccctacatgggaaaacagcagtgttggagatattgttgtagagattaaaggagagagttgtgctacaaatacaccaaaggaattagaaaattctgtttaaaattccatttaaaaagcttttataagaataaagatagaaaaatagatatgattatcttgatcattgacatttggaaaacacacaaattcattgctgaggtaaacaatctattatgggacagaatatacattcaataggtggtaaactgtggatttctcattctagggtgatttaaaattacctgaggctatgcaagtttctgtcataattcttcctcatatttacaaagaagaaagagattaaatgttgaaagggctgcgtagtagtaaaag

SEQ ID NO: 47248 - DNA, 201 bp, Homo sapiens
  misc_feature 44: n = A,T,C or G
actgaaaggaagggctaggtccttgcccctttgagggggttttnacatgactgggacctaagagccagaggctgtatagaggctcctgctccacctgccagtctcgtaagagatggggttgctgcagtgttggagtaggggcagagggagggagccaaggtcactccaataaaacaagctcatggcttaaaaaaaaaaaaa

SEQ ID NO: 47249 - DNA, 492 bp, Homo sapiens
cttcagatcatcagatcagtctcaaatgggtttcttgcaattctatcttcaggcaatatttatactatgccaaactcatttgcagttcttaggttggttaggttgaaacatctttttaaagcagtaagtttatagaaaatgttttcatttaatggaaggctggggaatgtccagcatcaacccctatggcatgcattcccagtggcttctcatctgggcctggaacctttggttcatggcttaggggagaacaggccacatggcaacagccacacagtcattgccttcaacacagagccacgtgtcccaaacagcaatagtcatgcccttgtccaggctgggatctaattgatacaataggtcggtgactccctcctagtagaactatctaggttgtctggaaaggttccgaccctggcttataggcaccacacctcatgtactcctcatggcttggatctctgtattcagcctttgtcagtccaataaact

SEQ ID NO: 47250 - DNA, 464 bp, Homo sapiens
agagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcatcatgtaaataatttccatatttctcttttataataaactaatgataactaatgacaaaa

SEQ ID NO: 47251 - DNA, 406 bp, Homo sapiens
tatcaagacaatacgagtaaatgaaaaggctgttaaagtagattacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgctacatttttgtaaattttcgaaatgctagtaatgtgttttcaccagcaagtatttggtgcaaacttaatgtcattttccttaagatggctacaactatgtaacctggattattctggacggacttattagaatacaaaccgacctaaaataaaccaaaccttgggtct

SEQ ID NO: 47252 - DNA, 214 bp, Homo sapiens
aaattccaggtatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgatacaaaaaaaaaaaaaaaaaaaaaaaaa

SEQ ID NO: 47253 - DNA, 290 bp, Homo sapiens
ctacctgccctacagaggactatgccggcacagtccttgctcaaccatggctgaaggaaaccagtgcaacagcactggctctctccaggatccagaaggggtttggactgggacttccttgctctccctcttctcaagtgccttaatagtagggtaagttgtcaagagtgggggagagcaggctggcagctctccagtcaggaggcatagtttttactgaacaatcaaagcacttggactcttgctctttctactctgaactaataaatctgttgccaagctaaaaaaaa

SEQ ID NO: 47254 - DNA, 470 bp, Homo sapiens
ggaagcctggagtgcctaagcctgcttgtagccagtgttgcccaaattgatttatgtaataagaacgggcagacagctgaagatctcgcttggcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtattacatgcctataatatgctggttgtgtatgctttgtcttttaaggtattaaaggacgcta

SEQ ID NO: 47255 - DNA, 500 bp, Homo sapiens
ccacagaatggattgggacacagcagcataagtgtgctacttggcagctagtaagtttaaagcaggacctgcttaactgctcctggccacttggaagtttagggtagatcttgttttccaaagtttcggcaggtgcctggagggcaaataaaaaagcagcagtcggtcagtagtcagtgatggagagaacaagaggagagatgcctggcctctgcccaagaaattagttttgatggaagcctgagcaagtcacctggttattgtaaccgtggagatctttgtaggtttagacatggctccctgtctccagtaaacatccagccattcagacaaagggggcctggagatcagagagcccaaatgcctgctggattgtctcctgatgagtcatgtggactcacctgaggaagggaaggaagggaataatcttttatggttcatttaccttatgaaaagtgttaaacattgccactcaaaatacatatttaatgcatgtgcaa

SEQ ID NO: 47256 - DNA, 544 bp, Homo sapiens
ggaatgtagacaagaagccagataaacctaaaagtgaagactttgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaaaaatatttaccttcctctagtggaatggccctttatataatgactaaatttggggaggaaat

SEQ ID NO: 47257 - DNA, 242 bp, Homo sapiens
ttatcaattatgcaaaagctcggaagatgccagaaactttcttaaatctccccaggaccagagctctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaaaaaaaaaaaaaaaaaaaaaaaaaa

SEQ ID NO: 47258 - DNA, 152 bp, Homo sapiens
caatacagcttccttgacatgtgtatcgaacggatgaatggacaaataaaaattaaattttgtaaatttctgcttattcctagaaaaagaatctaaattgtgacaaatcagaattgaaaaaagtattctaataaagaaaaacaagcttttat

SEQ ID NO: 47259 - DNA, 146 bp, Homo sapiens
tttcttaaacaaaataaaaattagatgggaatattgcttaagccctggaggttgaggctgcagttaactgtgattgcaccactgcagtccagcctaggcgatagagcaagaccctttctccaaaaaaaaaaaaaaaaaaaaaaaaa

SEQ ID NO: 47260 - DNA, 586 bp, Homo sapiens
  misc_feature 44: n = A,T,C or G
gggagtcctgactcagtcctgcaccaccccgcacctccactcantcctgaaggctaccaactacaatggccaccgtgtctacacttagcctctatccatggctacctgggcatcgtggagcttttggtgtccttgggtgctgatgtcaatgctcagctcacctggggccgccaagcacccggatacagcagcagctgggccagctgacactagaaaaccttcagatgctgccagagagtgaggatgaggagagctatgacacagagtcagagttcacggagttcacagaggacgagctgcctatgatgactgtgtgtttggaggccagcgtctgacgttatgagtgcaaaggggctgaaagaacatggacttgtatatttgtacaaaaaaaaagtttatttttctaaaaaaagaaaaaagaagaaaaaatttaaagggtgacttatatcacactgacactgcctagcccaaaacgtttattgtgggaggatcagccctatttgtggctttgtgaacttttggaggggacaagaaagatcatggaatctgagaaaacttttttaaacctacctttgggggttttggg

SEQ ID NO: 47261 - DNA, 488 bp, Homo sapiens
gccttctataaaattcagcaccccttcatgctaaaaactctctataaactaggtattgatggaatgtatctcaaattaataagagctatttatgacaaacccacagccaatatcatactgaatgggcaaaagctggaagcattccctttgaaaaccggtacaagacaaggatgtcctctctcaccactcctattcagcatagtataggaagttctggccagggcagtcaggtaagagaaagaaagaaagaaagggtataccgaataggaagacaggaaggcactttgtctttgtttgcagatgacataactgtatattttaaaaaccccattgtctcagcccaaaagctccttaagctgataagcaacttcagcaaagttgaagttgtgtgcaacacaaaatcagtgtgcaaaaatcacaagcatgtctatacccaataatagccaaaccatgagtgaattcccattcacaattgctcaaagagaata

SEQ ID NO: 47262 - DNA, 430 bp, Homo sapiens
actttttgccacaaatgagtctaaagtgcatttactctcttcctggcttagatatggtggtccagtgggccagtactatgattatgattgtcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaactattacctggaggtcaatcaacttgagaagtttgacataaagagcttctgcaagatcctggggccattatcctactccaagatcaagcatttgcgtttggatggcaatcgcatctcagaaaccaatcttcaccggatatgtatgaatgctacgggtgctacg

SEQ ID NO: 47263 - DNA, 436 bp, Homo sapiens
atccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccctgtgatctataaatcaagaaaatccattgtcataaccatttttaaaagtcaaaaattaagacatccttaattaaaaagttcaaatctagacactaaatgtgtgtgaatgtacaaagaaacaaaccattgcttatgctgtatatactagagaaatttggtttgcttgctgtttaacttgacagatgaaggactttagttgaact

SEQ ID NO: 47264 - DNA, 530 bp, Homo sapiens
ctgttgtcattgtaacaaattattacaaagcccatgatgttcatggcttaagacaacacaaactttttctcttatagttctaggtgtcagaagtctaacatgagtcttacagggataaaatcaaggtgtcagtagggctggttcattctgggagctttaggggagaatctgtttcttatttcttccacttcctaagactgcctgcattccttggcttgcggccacagtactcccatctctgcttctgcatgcatatcctttttctcttctagagcaaatctcccactgcctcacttttgtaagaacatttataattacatttagggcctacttggataatacaaggtatctctctatttcaaggtccttaacttaatcatatctgcaaagtcccttttccatataagacaaaactcacgaggtccagggattaaggatgaggtatcttggggaccattattcaagttatcacatcatcagtcaaagaaaacaaaattaggtttcagtagttatattaaagctatagttag

SEQ ID NO: 47265 - DNA, 108 bp, Homo sapiens
catatactgaacttatatacatcaaaagggattaatacagcgatgccaaaaagtttaatcacggacacacgtccgtttctgtagtccgtatgctctttcattcttgga

SEQ ID NO: 47266 - DNA, 276 bp, Homo sapiens
atgagctgttacaagaattaatcttacatataattactatcatagacaaccgatgtgtgagcagggggaggactctcacccagtggccagccgctctatgactgagagaaggggcggcctttctatcaaagatctaatggcccacctactttgctccatgaccttatgttagctgacccccacattatagaggaggagttcttggctctatgatgcgcctgctgtaggaccactgccccaggagagagggcgacccaaaatctcgtctagacaccc

SEQ ID NO: 47267 - DNA, 320 bp, Homo sapiens
ggacctatcccaaatgtggaattgactgcctatgccaagtccctggaaaaggagcttcagtattgtggggctcataaaacatgaatcaagcaatccagcctcatgggaagtcctgcacagtttttgtaaagcccttgcacagctggagaaatggcatcattataagctatgagttgaaatgttctgcaaatgtgctcacatctacacgtggcttggaggcttttatggggccctgccaggtagaaaagaaatggtatgtagagcttagatttccctattgtgacagagccatggtgtggttgtaataataaaacccaagg

SEQ ID NO: 47268 - DNA, 256 bp, Homo sapiens
aggatttctcgtgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttaaaaaaaaaaaaaaaaa

SEQ ID NO: 47269 - DNA, 220 bp, Homo sapiens
gcaatcagcgcaggggctactgctgagggggcagagctggttttcagaggaaaccgcagatagagttttcactctgttgaaagatatagatcaatacaactacttaaaaaatatagtcaataggcaactaagatatagctcaggcgtgaagttactaacgtaacttgtaatagctcaagattgtaagagataatatgaagacctagaggagtcgcgtgag

SEQ ID NO: 47270 - DNA, 301 bp, Homo sapiens
gaaacttcgatctcacttggttacaccacggctctggtacagatacaacttcatgatcggcgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggcctgcaataaaatcatttatttttcaaaaaaaaaaa

SEQ ID NO: 47271 - DNA, 234 bp, Homo sapiens
ataaatcaagcatgatcagggtgaggaacatgaaagaaggaattatggggaaatagggtgaatatcaggtggtcagagagatacagtcatgggggtcaggtgtggtatcaggaataatgtgagaggccagattgaagtccgggccaggaacaatggtaattgtgggacttaaagagtgagtacagctgaaggagccggggagcagaaagtatatgtgtcaagttaaaaaaaaaa

SEQ ID NO: 47272 - DNA, 460 bp, Homo sapiens
tctttctggcctggaggctatccagcgtactccaaagattcaggtttactcacgtcatccagcagagaatggaaagtcaaatttcctgaattgctatgtgtctgggattcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaaagtgggatcgagacatgtaagcagcatcatggaggtttgaagatgccgcatttggattggatgaattccaaaatctgcttgcttgcttttaatattggatatgcttataccttacactttatgcacaaaatgtaagggtataataatggtaacatggacat

SEQ ID NO: 47273 - DNA, 556 bp, Homo sapiens
aactcggcggtggccactgcgcagaccagacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctgcccaaggtgtcctgcaggctgtaatgcagtttaatcagagtgccatttttttttt

SEQ ID NO: 47274 - DNA, 362 bp, Homo sapiens
acaccataggtagaacgtaaagctgtgtcttgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagggtatattttttctaaa

SEQ ID NO: 47275 - DNA, 517 bp, Homo sapiens
tgaagatatattgctggaattagggaagtgtgtataatgaacctatatctgaggagcagagaaacccatgcatcatgagtgttaagaaagaaatcaatacaactcttctatttcaaggatgaagaatcataacctagaatgataatgcaaagtaaagatctttcatttagtacatatccagtaaaaacggagaatgttgcatctctgcagtatcccctttatatcataccagtagggttgtttcttaggcaaaggtttctgctttaagtatgatggtagaattaagcattagctatttttatgggtttttcttgttttttagattacctgctgacatgatataaacaattaatatatatttaaatgttaataacaacaggaaatatgaatctgagttaattgcacccaatgacatagtgttaaaaaatactggaaggtccactcgcaattatttctccagtggagttgtgaaatactgagagccttgatattcaccatcaggctgaaagaagtgatg

SEQ ID NO: 47276 - DNA, 144 bp, Homo sapiens
ctgcttcttaaaggactatcaggatttaatgggattctcagacggaaccaatactattgtctagagtattctaggggagaggctaatatgtgaaaggtgatcagtggcaggctggttgaaacaccaaacaaaacctttttgttt

SEQ ID NO: 47277 - DNA, 535 bp, Homo sapiens
ggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgattcaaatcaggcgttcacaaactgcattctttaataggtttaggtatcaaaaatc

SEQ ID NO: 47278 - DNA, 431 bp, Homo sapiens
gtgattctaagatttggtttgggatcaataggaaagcttatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgggggtgattattttttatactgtatgtgccaaagctttactactgtggaaagacaactgttttaataaaagattacattccacta

SEQ ID NO: 47279 - DNA, 231 bp, Homo sapiens
ttagtgcttcaaagtcaatttttaaaaatgcacaagttataaattcagaagaaagagcaacccaccaaacctacaaggacccccgaacactttcatactgagactgtaagtagatctcagttctgcgtttattgtaagttgataaaaacatctggaagaaaatgactaaaactgtttgcatctttgtatgtatttattacttgatgtaataaagcttattttcattaacag

SEQ ID NO: 47280 - DNA, 315 bp, Homo sapiens
aaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattacttttttttttccaaaccctgcttttgaaatatccttgtacttaaaattcatattgctaagacactgtattagaatatttaatattccccagatcctcttaggataaactgtgggaacctcctatgccatggatatcaaaggccacattag

SEQ ID NO: 47281 - DNA, 219 bp, Homo sapiens
acagccacaagcgcatagtttgtgcgggcccagcacggaggaagacacgttcgagggggcaagcagaaacgaagggacgccatgacggagaagagaacgccagaaggagccgccattgccccaggcatcaacaaaaccgggctgggccaaaggaacaaggaatggggcccttaccgaaaccgggtgccgctggccagaaaacggaaagagggaggagaa

SEQ ID NO: 47282 - DNA, 410 bp, Homo sapiens
aggaagactcatttgtctcttgttcttttactaaagcaggcaaccaatataaatgcaagcataattatccattattttggcactgattgatacatatttattggtgtaagtatatacacttttagtttgatactggcaagaggcccttgttaggaggagcagcatgacacagtgtttacagtgacattgccaaaccatggatttttttggttactagttactttcacgtctttgagccccagctattccaggtactcatttgtaaaaaaagtaggtgatgtgctcctatagcatgtgaatttatacctaaagtaattaatttcttgcctctatagataaatattggtgaacttttaaactactttttcctagtttggatttataaaatggtgtggtcctctctcctttag

SEQ ID NO: 47283 - DNA, 469 bp, Homo sapiens
ctagtcaaaaggaaatagaagaatgggaaagaaaacttctatctcaagcagctccaacttgtatggagaccatgtgggaaattccagctattgggcatttcctttgtttagctcagcaaattctaaatttgccagaaatagtcttttacgaactggaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtcaacagtggtacactgctgtagggcaaactgaaaatcctgataactgtgctgaaaaactggggttgtgcctcagttttttaaagttcttggagaagttaatccattggaagaaaaaccttttcacgaactacctttttaccaaaaagtgtggctcttaagggcctttg

SEQ ID NO: 47284 - DNA, 304 bp, Homo sapiens
attcttgcaaggaaggtgatggcaagtggaaaaagacataacaagcaatgatgagtaaagaaagtggtaaatatttggacagttctaaatacatgtaaaagaataatgttggagaggctggaacaaggataagattaaatacatgaaaacagtaacatctaagttggaagggataatagaattaatttgggggggtaaagatttgtttaactttgaattttgtgagtgctgtgtgttactgtttttttttttaaaggtaattgctaaaaagtagaaacattggaaaaaaaaaaaaaaaaaaaaa

SEQ ID NO: 47285 - DNA, 278 bp, Homo sapiens
gctgagatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcatt

SEQ ID NO: 47286 - DNA, 504 bp, Homo sapiens
tagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaggtatctattgcttagcatatgtaaaggtgtagtctatatttatgggccattgcttaaaggattataaattatgtaaatacattaataaattctaagttcatttgcattc

SEQ ID NO: 47287 - DNA, 400 bp, Homo sapiens
cggaagctgacagcattcgggccgagatgtcccggctccgcgacctaagctgtgctcggcgctactctctctttctggcctggaggctatccagcgtactccaaagattcaggtttactcacgtcatccagcagagaatggaaagtcaaatttcctgaatcgctatgtgtctgggtttcatccatccgacattgaagttgacttactgaagaatggagagagaattgaaaaagtggagcattcagacttgtctctcagcaaggactggtctttctatctcttgactacactgaattcacccccactgaaaaagatgagtatgcctgccgtgtgaaccatgtgactttgcacagcccaagatagttaagggggaacgagacatggaagcagcagcagggag

SEQ ID NO: 47288 - DNA, 263 bp, Homo sapiens
cgactgcgccgaggcggccgggcggtttaggttaatgattaacaaaggcgtccgaagaaaccgaagccggaaggtgaccaaggcggaaagagacgttgctaaggcccgcaagtaagaagagagagggaatagcctgaaggagtaacactaaatataaaatgacacttggggaccaaccaagcgaaagcagatgttcaaaggggatatcgccagaggctggcacactaagatgagaaatggccggctacccgaaggggctgacg

SEQ ID NO: 47289 - DNA, 390 bp, Homo sapiens
ccagcgtatacaagacagagaagccattacgccggccctgagccggacagacgcacctttggtcatcggtggtgctgaccaggaaggctctgaggacaccggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagaggaaaagaaggattgatcagagcattgtgcaatacagtttcattaactccttccctcgctcccccaaaaatttgaatttttttttcaacactcctacacccgttatggaaaatgcaacctttggaagaaac

SEQ ID NO: 47290 - DNA, 249 bp, Homo sapiens
cactttccctgggctatgggcgggggtgccaaccaggccgagtggtttgaggacgatggatacagcgcaagagggagctgtggccacctgagaagctgcaagagatagaggaattcaaagagaggcacggaagcggcgggaggagaagctccttcgcgacgcccagcagaactcctgaggcctccaagtgggagcctagcccctcccctgatgaaatatacatatactcaggcctcgtaaaaaaaaaaa

SEQ ID NO: 47291 - DNA, 570 bp, Homo sapiens
tgtacaaccctacgtcaataacctgaccttagaattttgcgagagccaagctgacttcaggaactggttatcagcacaaagaagcaatcagcaaataattccgaacacaaatttaatatttttttttctgaatgagaaacatgagggaaatggtggagttagccccccgtggtaaaggaattgaagaaaatataacaccttacaccctttttcatcttgacattaaaagttctggctaactttggaatccattagagaaaaatccttgtcaccagattcattacaattcaaatcgaagaggtgggaactggtatcccattgaaaagaccgagccctggatggatggtatggaacataaaagccgcaagccattatctccccatgggaagctaaggtataaaaaaagggtgctgggggacaaaactttttatatcaaaaggcttggcccatttctatatgagggggttaccgggaaataagggaatttttacaccaatttggacccccagaagggtggcaaagcctctggcaggcaatttttaaacccaacggtcaaaaaacccttttcag

SEQ ID NO: 47292 - DNA, 386 bp, Homo sapiens
gactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaagaactgttcttttgcaataataataaattaaacatgctggtaccagagcctctttgctggagtctccaggatggtaatttactttctgcccccaattgggaatgcaatattggatgaaaagagagggttctggaattcacaagaaagctcgatatgccttaaaacatactctggcgatctaattacaggcttatttt

SEQ ID NO: 47293 - DNA, 152 bp, Homo sapiens
tcagagtacaccaactacggggcagcccaaaaaggcgccaaatgcacataaatcctgataaacaaagtccacaaaataaaacacgggacactagctttgggaaaagtaacgaaaacacaacggttttagaaatcctgtgttaaatattgcca

SEQ ID NO: 47294 - DNA, 510 bp, Homo sapiens
cgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctgcccaaggtgtcctgcaggctgtaatgcagtttaatcagaggcc

SEQ ID NO: 47295 - DNA, 160 bp, Homo sapiens
ctctgcaaatgccccggctgctctctaccagacaattgaagactatattaaaatctctgaagaagaagaagttgaagggatcagtgtgcctgtcccaaagtcagcctaccgtgatcctgccgacatcgttcatgactgtaacatgaaacttacagcccat

SEQ ID NO: 47296 - DNA, 449 bp, Homo sapiens
acccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgcaacgaaggccgcgcctgctttcccatctgtctatctatctggctgcagggaaggagagaacttgcatgttggtgaaaggaagaagtggggtggaagaagtggggtgggacgacagtgaaatctagagtaaaacccaactggccaaggtgtcctgcagctgtaatgcagttaaatcag

SEQ ID NO: 47297 - DNA, 531 bp, Homo sapiens
cctgagtcgtacagaaagctgcctggtatatccaaaagctttttattcctcctgctcatattgtgattctgcctttggggacttttcttaaaccttcagttatgatttttttttcatacacttattggaactctgcttgattttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaatttatatgcttactgatatattttacaattttttatcatgcatgtcctgtaaaggttacaagcctgcacaataaaaatgttacgggt

SEQ ID NO: 47298 - DNA, 220 bp, Homo sapiens
aaggcaaactgagactggtgagaaatagtcgggtgccaaaagcacatgtaagacagagcccaagtctgtatcaaaagttctgagaacactctaggcattaatgtgccaaggagccgtttctgcctgtcaaaaccacatcagatctctcgctggcgatgtcaaacctctacaggcttaatgcaggatctctgacaatgagggaaaagcgggaattcctaca

SEQ ID NO: 47299 - DNA, 359 bp, Homo sapiens
tgatgtattttccagctacataggctcagtcaaattctaggcatgtctccattacctcactgaattttgctctgggagggctcaagaaattttttaccattctgaagtaatatgtaggaacacaaattcattttaaaattatccaaaatagaacataatcaagaaagcaaaccagccacaaaaatttaccaacaatgcatgcaaaaaccaacttgaagtactttttaaaattatgtagtttttacaaatgcctttgctattgacccaggagtgcatgtaattataaactgactcatcaaagtgttctaattccaaggctagaatccattaacttataagactctccaataagagcatgt

SEQ ID NO: 47300 - DNA, 368 bp, Homo sapiens
ttaaagtgagtatactgtggagaggacttccaaatgtggttttctcagctatatcactgcccaacatcagaaaacctgacggctatgattactatgccttttctaaagatcaatactataacattgatgtacctagtagaacagcaagagcaattactactcgttctgggcagaccttatccaaagtctggtacaactgtccttagactgataagcgaaggaggagtcaactaatgaagaaatgaataataaattttgacactgaaaaacattttattaataaagaatattgacatgagtataccagtttatatataaaaatgtttttaaacttgacaatcattacactaaaacagatttgatatcca

SEQ ID NO: 47301 - DNA, 422 bp, Homo sapiens
tgagaaatcatgccttaaccaagtgacacattacttcttttttttattttttatttatttattttttgccctgtcttatgctgctgagctacttcttaagaaaataaaaatgtgataattaaaagtaaaaattaccgtgttgaaagatttgattctagctctttcattaaactaggaaactcttaaagtatggtttttattgtgtaaatatttttttaatttgaatttttaccataatattatagaagacactggcccctcagaagatagtttgcttttagtctcaggcctaagtggtaacatctagggatataatcttgacaaattacttaacttccctgagaatcagtttccttatatgcaaattaaatctgtgattatataatagaggttctatgcaaattaattgaaacacatatctg

SEQ ID NO: 47302 - DNA, 540 bp, Homo sapiens
gatagaacctttgctgttctcgcatacagcaatgtactttgaaagggaagcacaggtcggaacaacagagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatgggcagaaataccagaaggtgagaaactaattttttatgcatcttcaaaaaatgaagacagggtgttttttttcctgttcaagaaagaaacacaactttcatgattcattacccagccccttgtatggcaatattccagctacatttgatcctctaaaaattgcacaggcagctactttatgtaaaagcagttacaaaagcaataaaatgtcacacagctg

SEQ ID NO: 47303 - DNA, 519 bp, Homo sapiens
ccttgagcaatacacaaaaccaccacaaaattagatttattgactcaaaatgaaaacatcagcttactggtttgtagttcataccagtcatacattccaaaacatgttttgagtcttactctgtgcctgaccttgtgcttgataacagggatataatgggaagcgacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttggtagtgtaaagtgtgactgtggactgtatgagtattttaagattatggagtaaagtaaggtttaaaaagcagccctaatcatcaaaagt

SEQ ID NO: 47304 - DNA, 508 bp, Homo sapiens
gaggcagccagcgcaggggcttctgctgagggggcaggcggatcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaccgaaggtgattaaaagaccttgaatccatgacgcagggagaattgcgcaattt

SEQ ID NO: 47305 - DNA, 248 bp, Homo sapiens
tgctcatgggaagaacagaattgctcctgcattcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatggc

SEQ ID NO: 47306 - DNA, 226 bp, Homo sapiens
aggaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggcttttctcaaaaaaaaaaaaaaaaaaaaaaaaaaa

SEQ ID NO: 47307 - DNA, 360 bp, Homo sapiens
cgcgctctgtttcggctgctgcaggatcatagggatacagccgagccatgtgtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttggcaaatatggcctgccgatgtggaagacctcggaagtggagctacagatagaaagatgatgatgacattgacctctttggatctg

SEQ ID NO: 47308 - DNA, 420 bp, Homo sapiens
caaatattcatattacttaatgaatatgttaaggaccaggctagtagtattttctaagctggaaacttagtgtgcctgggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagaaattatctttctaatgctctgtgaggccaaacatttatgttcagattgaaatttaaattaatatcattcaaaaggaaacaaaaaatgttgagtttaaaaatcaggattg

SEQ ID NO: 47309 - DNA, 339 bp, Homo sapiens
aaaatctgacaatcgcttatgctattacattcttaaagcattagtgctttaaaattgttatgctggcgtttgaaacatgatactcctgtggtgcagatgagaagctataacagtgaatatgtggtttctcttacgtcatccaccttgacatgatgggcagaaacaaatggaaatccagagcaagtcctccagggttgcccaggttacctaaagcttgttgcctttcttgtgctgttatccgtgtagagcactcaagaaagttctgaaactgctgtgtatctgctttggactgtggtgcctcttggaattgaccccaaaatctgcatagattatttaggt

SEQ ID NO: 47310 - DNA, 315 bp, Homo sapiens
ttgaatcccaacaatgacaccttggacaaagtgtttaatcaccctgagtctcaatttattaatctctacaattattcttactttattttaagattctttcgagtatttgttgtagaatgcacagcttagttaatggaatttttgaacatacactaagccttgacacagaagtatgagaaagatgtaaatggatgtgctgaaatgtgaaacatagaaacattgtcatgtgaccctacagtactgctattttctaaacaggttttctgtaattagactgtctcactcatgtgtaagggttccatgtatcttctgaac

SEQ ID NO: 47311 - DNA, 359 bp, Homo sapiens
aacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgcactgaatagggcccagtataggggcttgcttttctactccctccccccaatataaaaatatagacttttttttgtggtcccaaaaaaaaaa

SEQ ID NO: 47312 - DNA, 300 bp, Homo sapiens
  misc_feature 21, 61, 110, 161, 175, 193, 197, 219, 267: n = A,T,C or G
atgataaagggcacataactntcctaaacctcacaccacctcttgaatagggataataagnccacatcaatgctgatgccttagctattattaaactcttacagtatgangtaaagtgaaagtacaatgtaagatcattcctaggccaactttgaccagtnttatacagaaacangtgccaacttttctgttngcanggataatatcaaagcaaacacnagaaagttatatctttgatgcatttttgttcaaaatcatacacataanacacaaaccaaagacaaatgatgaatattatgg

SEQ ID NO: 47313 - DNA, 289 bp, Homo sapiens
aaaaaaagcggacagaaacgcgattatcgagcccgagggcaggccccacggggcccgaggcggaaaacctggcacttggggaggccaaggtgggaggaccagtggaggccaggagcccaagaccagccggggcaaacaaagcgagatcccacccccacaaaaaatttaaaaaataagccaggccccggctaaagccaggaccccatcaggcccccgggccaaagcaacagagcaagaccccatccctaaaaaaaaaaaaattaaaaacccagggaaaaaaggaaaggcc

SEQ ID NO: 47314 - DNA, 497 bp, Homo sapiens
ctgatcggctgtatgactccatgaagggcaaggggacgcgatataaggtcctgatcagaatcatggctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttcagctaacaggtctagaaaaccagcttgcgaataacagtccccgtggccatccctgtgagggtgacgttagcattacccccaacctcattttagttgcctaagcattgcctgccttcctgtctagtctctcctgtaagccaaagaaatgaacattccaaggagttggaagtgaagctatgatgtgaaacactttgcctcctgtgtactgtgcataaacagatgaataaactgaattggacttta

SEQ ID NO: 47315 - DNA, 276 bp, Homo sapiens
aagctggagatatttcggatgataatctacctttctttccctgtggctatgttctgggtttccaatcaggccgagtggtttgaggacgatgtcatacagcgcatgagggagctgtggccacctgagaagcttcaagagatagaggaattcaaagagaggttacggaagtggcgggaggagaagctccttcgcgacgcccagcagaactcctgaggcctccaagtgggagtcctagcccctcccctgatgaaatatacatatactcagttccttgtc

SEQ ID NO: 47316 - DNA, 630 bp, Homo sapiens
agttgatgcagctagcctgaaaggactgaataatttgtctaagttgggattgagtttcaacagcatctctgctgttgacaatggctctctggccaacacgcctcatctgagggagcttcacttggacaacagcaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatcagccatccaccttcagatgtgtctacgtgcgctctgccattcaactcggaaactataagtaattctcaagaaagccctcatttttataacctggcaaaatcttgttaatgcattgctaaaaaataaataaaagctagatctggaaacctaactgcaatgtggatgttttacccacatgacttattatgcataaagccaaatttccagttaagtaatgcctcaataaaaagaaattttgcctgccatttcagaatcatcttttgagcttctgtggatgtaactgagctactagagatattcttattcactaaatgtaa

SEQ ID NO: 47317 - DNA, 443 bp, Homo sapiens
agcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaggttttaaaatcagtacttttttaatggaaacaacttgaccaaaaatttgtcacagaattttgagacccattaaaaaaggtaaatggg

SEQ ID NO: 47318 - DNA, 205 bp, Homo sapiens
  misc_feature 200, 201, 202, 203, 204, 205: n = A,T,C or G
gcggatgagaatggcaaaattagtcgccttcgacgagagtgcccttctgatgaatgtggtgctggggttgttatggcaagtcactttgacagacattattgtggcaaatgttgtctgacttactgtttcaacaaaccagaagacaagtaactgtatgagttaataaaagacatgaactaataaaaaaaaaaaaaaaaaannnnnn

SEQ ID NO: 47319 - DNA, 410 bp, Homo sapiens
ttaacattacgtagctgattctgccgcagctagaaatgctcaggaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgcatggaaatgatgagtcagaagattcagcagctcacagccctgggggcagctcaggctactgctaaggcctgagagtttttgcagaaatgggacagagggacaccctttgggcgcggcttcctggtgatgggaagggtcttgtgttttaatgccaataaatgtgcca

SEQ ID NO: 47320 - DNA, 174 bp, Homo sapiens
gctctatccgaggaattctcatgtggcattccccttgccagacttggactttggatctctcttccaagcctttctgacttcctcttagatcatagattggacctggatttgttttcctgcagctgatgacttggttgccctggaggacaataaaaaaaaatcattttgctccaa

SEQ ID NO: 47321 - DNA, 462 bp, Homo sapiens
atgcaccaaagcccgatacctgaagaaaaagaacttgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttgccagtaggaggcgacacgaaggatttgctgctgccttgggggatgggaaggaacctgaaggcattttttccagggtggtgcagtaccactgaggactgttgctgtattgattaggaaaagagacagagtaatttgcagtttgttgatttatacttttgttatctacaacccaataacagacatgagggatggccctgctctctgggacagagcctcacagatgatgtccatgttttgtgtgaatgaaactaaacactctc

SEQ ID NO: 47322 - DNA, 334 bp, Homo sapiens
tcatttacataaatattatactagcatttaccatctcacttcttggaatactagtatatcgctcacacctcattcctccctactatgcctagaaggaataatactatcgctgttcattatagctactctcataaccctcaacacccactccctcttagccaatattgtgcctattgccatactagtctttgccgcctgcgaagcagcggtgggctagccctactagtctcaatctccaacacatatggcctagactacgtacataacctaaacctactccaatgctaaaactaatcgcccaacatttatattactaccactgacatgactttcc

SEQ ID NO: 47323 - DNA, 220 bp, Homo sapiens
tttccatatctgaacaggcccttctcaaatttttggtagtcttggtgccttgaacaaagcagatctttaacagcttctatcactttgttcttggtctttaagactgtagctatggtagaatgggactgcctgactggtgagcaatactatcactgatcttccctttcatcgtcctaatcacttaatttttttccatggcagtcactcgatgtggcccttc

SEQ ID NO: 47324 - DNA, 361 bp, Homo sapiens
ataggaatcatgtctggtcgcggcaaaggcggaaaaggcttggggaagggtggagctaagcgccatcgtaaggtgctccgggataacatccagggcattacaaaaccggctattcgccgtttggctcggcgcggtgcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggctcctgagaactccaaaaaaaaaaa

SEQ ID NO: 47325 - DNA, 448 bp, Homo sapiens
gccagcgcaggggcttctgctgagggggcaggcggagcttgatgaaacccgcagataagtttttttctctttgaaagatagagattaatacaactacttaaaaaatatagtcaataggttactaagatattgcttagcgttaagtttttaaccgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatccaatagaagggcaatgcttttagattaaaatgaaggtgacttaaacagcttaaaggttagttaaaagtgtaggtgattaaaataatttgatgcgatcttttaaaagagattaaccg

SEQ ID NO: 47326 - DNA, 110 bp, Homo sapiens
aagctgtatttttgaactctgcctcatagcttagtacatgaaggaaatttttttttggttttgttttttataattcagtttaatcaataaacatgtatttattgactgtt

SEQ ID NO: 47327 - DNA, 296 bp, Homo sapiens
catgactatgtcaactgctagagaaagttttgaaaaaaatcaatacctatctacaataaaatctctcggcaaactagaaacagagggtatttcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggaaaaaaaaaa

SEQ ID NO: 47328 - DNA, 368 bp, Homo sapiens
tttcaaggacccagaagtagggttttggcctaggcaacggttcagagatgtggctcgagattctccccggactggcgtcatgggccgtgtgcttgtcgattccaggactggctactgcgaacatccacaggttcactaacgggggcaaggaaaaaagggtggctcataatggggatcactggaggctgatggaaagagataggcgccccactggagttgatcgttactatgtgtcaaagggtttggagaacattgattaaggaagcatttcctgattgatgaaaaaaataactcagttatggccatctacccctgctagaaggttacaggtgtattatgaacatgcaatgtggtatgtagtgcttaat

SEQ ID NO: 47329 - DNA, 480 bp, Homo sapiens
taaggaacttagtgatttggtccgtgaccctccagcacaatgttctgcaggtccagttggggatgatatgtttcattggcaagccacaattatgggacctaatgacagcccatatcaaggcggtgtattctttttgacaatccattttcctacagactaccccttcaaaccacctaaggttgcatttacaacaagaatttatcatccaaatattaacagtaatggcagcatttgctcgatattctaagatcacagtggcgcctgctttaacaatttctaaagtcttttatccatttgttcactgctatgtgatccaaacccagatgaccccctagtgccagagattgcacggatctataaaacagacagaggtaagtcaacagaatatctcgggaatggactcagaagtatgccatgtgatgctaccttaaagtcagaataacctgcattatagctggaataaactttaaattactgtta

SEQ ID NO: 47330 - DNA, 630 bp, Homo sapiens
tcctgcatcatatcgcggtgtaacccccgaagtttagcgagctccggaggaatttcagtatctgctacggtaacttcatcagcccgccaagatggcgatgcaagcggccaagagggcgaacattcgacttccacctgaagtaaatcggatattgtatataagaaatttgtcatacaaaatcacagctgaagaaatgtatgatatatttgggaaatatggacctattcgtcaaatcagagtggggaacacacctgaaactagaggaacagcttatgcggctatgaggacatctttgatgccaagaatgcatgtgatcacctatcgggattcaatgtttgtaacagataccttgtggttttgtactataatgccaacagggcatttcagaagatggaccaaagaagaaggaggacagttgaagcttctcaaggagaaatatggcatcaacacagatcaccaaaataaatggtttctacattttcatttggactaaatccacgaatgacactccacctttttttccttttaattaatactaaaaattgggattcttatttgaggtcaaaatgacctgcttgaactttgatacatttggaatcattttgttaataaactggagctttttgtggg

SEQ ID NO: 47331 - DNA, 370 bp, Homo sapiens
tgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagtttatgtcttttgaa

SEQ ID NO: 47332 - DNA, 341 bp, Homo sapiens
ccatggatggtggtttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgc

SEQ ID NO: 47333 - DNA, 386 bp, Homo sapiens
cctaggcaacggcgcagagaaggggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggttggagacattgattaaggaagcattttcctgattgatgaaaaaaataactcagttatggccatctacccctgctagaaggtacagtgtattatgtagcatgcaatgtgtatgtagtgcttaataaaaataaaatgaaaaaaatgcaaaaaaaaaaaaaaaaaaaaaaaaaaa

SEQ ID NO: 47334 - DNA, 476 bp, Homo sapiens
aaaaaatttttaagaattgtttgcacgttatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctgggttttggatcttatgatgctgagcatgtctgcctggggctaatgtctaatataattttatatttacacacatacgtgctcccagagattaatttagtccatatgaactattgacccattgtcattgagacagcacatacccacccctaaacagggtgtttagactttcaggttctaactcatttccaaacatgaccatgtttataacctttggttc

SEQ ID NO: 47335 - DNA, 590 bp, Homo sapiens
gctatcagcttcgcagtacctactcaggcagccagctgagaagagtcgagggaaagtgctgctgctgggtctgccgacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggtattttgcctttgcttgatattatcaactcactggtaacaacagtattcatgctcatcgatcttgtgttggcactgataccagaaaccacaacattgacagttggtggaggggtgttttgcacttgtgacagcagtatgctggctttgccgacgggcccttatttaccggaagcttctgttcaatcccagcgtccttaccagaaaaagcctgtgcatgaaaaaaaagaaggtttggaatttaatatacttttagttggatactaagaataaacaaattctgatcttcccc

SEQ ID NO: 47336 - DNA, 433 bp, Homo sapiens
caattcatattctggagaagactattcagtgtgcacctacagatgatatattagtagaattactaaaggaatatacctgctgcagaaaacatgcttttaaattaagatgattatggaatgaaaccacaccgatgagaggctgctttcattaataaccttttccttcatttacaagattctctgaattattttggaaactatgtcccaattcatggacacaggatgatggctgcactctttgtgaattcgatcagtcgcttgctgcagtagatgtccatccaaacgtatcaataggggttttattgagcaccacccctttctacctcggttctggaatatggtgaactggattacccaaaagagcacttaacttttattctaacaaagaagttatcatgaaaggacatcaagggatttttgataaagctaagcc

SEQ ID NO: 47337 - DNA, 565 bp, Homo sapiens
tctctgcccaggatcccatccagaatatcacattacatttagttgacgggtctccttatgtaccccttggctgtaacagtttctcagactttgcttgtctggaatgaccttgagaattttgaggagtgctggtcaggtgttttgtagaatgttcctcagtcccaccattttttacccaagatatcctaccagaggacagacctcatgcagttttcataggcatctcttaactgcacaaccagagaataactttgggatgttgggaaggaggccttcaaattcattcgttttgccgggagcgctgagcccttggtgtgtgcggagaaggcatcagaggaggcacaaaggaggatgcaggggagcgggagatgcgggttgagtgccagttggttctcttccccacctccttcggtctctggctctcctttgtgaaggaaggggtgcacctgagaacgcacagggtatatcaaatcggggtttctcaaagtgaggtagaaggggcagcttgtactggaatcccaaaggtacctggttaaaatgcaaattccttgcagaactttatccc

SEQ ID NO: 47338 - DNA, 251 bp, Homo sapiens
tcgtgagacgccacgcggccaagatggctaaggagatcgagagcaagactgcttttcaggaagccttggacgctgcaggagacaaacctgtagtagtcgactactcagccacgaggtgagggcctatgcaaaaggaccaagcccaccggccaagccctcgctgaaaagcaagccaacgagataaaccctgaagcagatgaggaagacagacaggaagcagcatgagagggggaagcaaatgcatgccaaca

SEQ ID NO: 47339 - DNA, 526 bp, Homo sapiens
tggcggacgacgtagaccagcaacaaactaccaacactgttgaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgcctgtatggaaaacgggagactttgtacagtgcctctctaaaagtcaaaacattcataagagaacctgctacattttgatattaagaaataattccggggatcttccactcctgaaatgagttgatttgcagatactcacaacttcttaagctaaatggtattttcatttttctcaagctctccattaatttgacccccaagatg

SEQ ID NO: 47340 - DNA, 151 bp, Homo sapiens
aatgctttgcggaccactttggttttcttttttgcgtgtggcagttttaagttattagtttttaaaatcagtactttttaatggaaacaacttgaccaaaaatttgtcacagaattttgagacccattaaaaaaaaaaaaaaaaaaaaaaa

SEQ ID NO: 47341 - DNA, 451 bp, Homo sapiens
aatagagcccgcaagggatagacgaaaaggtataaccaatcttaatatagcaaggactaacccctataccttgggcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccccaattaagaaagcgttcaagctcaacacccactaccgaa

SEQ ID NO: 47342 - DNA, 253 bp, Homo sapiens
accaaactctatctgaaatgccaacaaaaaaaatttaactccatatgtgtcctcttggctaatcctgcaaccagtgcaagtgaccgacaaaattccagttatttatttccaaaatgtttggaaacagtataatttgcaaagaaaaatgatctctctgtttttgctgttccaccaaatacaattcaaatgctttttgttttatttttttaccaatccaattcaaaagctcaatggggctataataaataaactt

SEQ ID NO: 47343 - DNA, 357 bp, Homo sapiens
acgattttatgatccaggccaacatatttttcgtatcatgcattttcaactttatattgaaagtcattctgaatagaagtccatgttcagaaatttagtatgttaattattcaacttagaaacttctgtgctggaatgattcacctggtgaggaatgattgtttacacaccctatttattccttatgaatttctacactccccctctggtctgtgtctttcattggttctggggtgatggttcctgctgcactgtcatatctgtctaccatcaatggagatactaatctctctccactcttcatgctgagatatggaaaatatccttcatttaactacatgcagtagaactttcact

SEQ ID NO: 47344 - DNA, 168 bp, Homo sapiens
gacagaagcaaaacctaggtcattttacttcagatacgtcatccagaatggtttaaactgatgacttttatatgtacactgaccatgtgatgtacatttattatggctttttttaaagaatggaaatatttatttcagaggccttatttttggacatttttagtgtag

SEQ ID NO: 47345 - DNA, 391 bp, Homo sapiens
ttcggagcgggagtgttcgttgtgccagcgtctaaaaagagaagtaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttatt

SEQ ID NO: 47346 - DNA, 388 bp, Homo sapiens
tattggatatcaactgcttgtaaaggtgctcctcttttttcttgtcattgctggacaagattactaatatttgggaaggctttaaagacgcatgttatggtgctaatgtactttcacttttaaactctggatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatctttttttttccttacagacacccataataaaatatcatattaaattc

SEQ ID NO: 47347 - DNA, 475 bp, Homo sapiens
aaagccaaattttgaggacgtggaccgtgggtttctttccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtccttgagatactgatggccctaatatcggttatctctatctgaagacctgcagtttagcttttcttcacctctacttaattgggcagctttaacccctttccctggtgaactctgctttttatcctctgagaaaacagcccacaggactgggtcctccttatccgcttgcttttaacctatgtaaattctgtgggtgctatcttatgtaaaatatagtaaaaattattggatataggttctattaaatggtaaagaaaatgttatgaaacca

SEQ ID NO: 47348 - DNA, 392 bp, Homo sapiens
gaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaatcacccccactgaaaaagatgagtatgcctgccgtgtgaaccatgtgactttgtcacagcccaagataggtaagtgggatcgagacatgtagcagcatcat

SEQ ID NO: 47349 - DNA, 490 bp, Homo sapiens
tgatggggtcaaatgaaggtgaattcaaggctgaaggaaatttcaaattcacctacacagttctggaggatgggtgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgcaaccagtgcaagtgaccgacaaaattccagttatttatttccaaaatgtttggaaacagtataatttgacaaagaaaaatgatcttctcttttttgctgtccccaaatacaattcaaatgcttttggtttattttttaccaattccaattcaaaatgtctcaaatggtgctataataaataaacttcacact

SEQ ID NO: 47350 - DNA, 285 bp, Homo sapiens
acaaacgagtcctggccttgtctgtggagacggattacaccttcccacttgctgaaaaggtcaaggccttcttggctgatccatctgcctttgtggctgctgccctgtggctgctgcaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttactttttt

SEQ ID NO: 47351 - DNA, 365 bp, Homo sapiens
atcaacccacattaagagtgtctaaggactcctgagaattcctgttacagtaaacaaaactaacgtaatctacatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttagaaaaaaaaaaaaa

SEQ ID NO: 47352 - DNA, 386 bp, Homo sapiens
gtaacacgtgtaacacgtgaaggcagcgctcacctcttctttatcagaacggccctttgaccagcacattaacttgtggactgccggctctagtaccttttcagtaaagtggttctctgcctttttactatacagcataccacgccacagggttagaaccaacgaagaaaataaaatgagggtgcccagcttataagaatggtgttagggggatgagcatgctgtttatgaacggaaatcatgatttcccttgtagaaagtgaggctcagattaaattttagaatattttctaaatgtctttttcacaatcatgtactgggaaggcaatttcatactaaactgattaaataatacatttataatctacaactgttgcacttacagc

SEQ ID NO: 47353 - DNA, 389 bp, Homo sapiens
cttatatgaaaacagtgcagaaaggtgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtattttttccaaaaaaaaaaaaaaaaaaaaaa

SEQ ID NO: 47354 - DNA, 486 bp, Homo sapiens
gaagtggaagaaacgcggaaccatggtcgctgtgtttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcgattaagagagctcaaataatggggtttatgccagttacatacaaggatcctgtatatctcaaggccctaaagttgtaacatcagatatcgggaataaattctatcacgttccactaataaacttattttacagt

SEQ ID NO: 47355 - DNA, 412 bp, Homo sapiens
gcttaaagcttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggccgaagaaaagaatagagaagatagggaaattagaagataaaaacatacttttagaagaaaaaagataaatttaaacctgaaaagtaggaagcagaagaaaaaagacaagctagggaacaaaaaagctaagggcaaaatgtccaaacctagaagaaaa

SEQ ID NO: 47356 - DNA, 450 bp, Homo sapiens
ggagagagcaagcagcgagtcttgaagctctgttcggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattaggccgaatcatgttttctgaaaatataaccagccattggctat

SEQ ID NO: 47357 - DNA, 270 bp, Homo sapiens
aatgaggcacactgaatcgaggcaacttctgaagataaaacctgaggaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctctgcctac

SEQ ID NO: 47358 - DNA, 253 bp, Homo sapiens
ttaagaggtcgagaccatcctggccaatatgatgaaaccccatctctactaaaaatacaaaaattagctgggtgtggtggcgcgtgtctgtaatcccagctacttgggaggctgaggcaggagaatcgcatgaacctgggaggtggaggttgcagtgagccaagattgtgccactgcactccagcctggcaacagagtgagactctgtctcaaataaataaataaataaataaataaataaataaataaataa

SEQ ID NO: 47359 - DNA, 632 bp, Homo sapiens
gaacacagctaaccagggggtggaagatctcttcaaggagaacttcaaaacactgctccaagaagacagagatgacacaaacaaatggaaaagcatttcatgctcatggataggaagaatcaatattgttaaaatggcgatgctgcccacagcaatttatagattcaatgctattgctattaaaccaccattaacattcttcaaaaaactagaaaaaactattttaaaatttatatggaaccaaaaaagagcctgaatagccacggcaatcctaagcaaaaggaacaaagctggaggcactgaaacagcatgatattggtacaaaaacagacacatagcccaatggaacagaatagagaactcagaaataaggccacacacctacaactatctgatctttgacaaaaacaagcaatggggaaaggattccctattcaataaatgatgctgggataactggctagccgtatgcagaagattgaaactggccccttccttacaccatatgcaaaaattaactcaaaatgaattaaggacttaagtgaaaaacccaacgctataaacccctggaagacaacctaggcaatccattctggacataggaagaggcaaagattcatggcaaagatgcc

SEQ ID NO: 47360 - DNA, 516 bp, Homo sapiens
caagaattatgtacgccttttatcaaagacttaagagccaaaaagcttttcatctctccagggggaaaactgtctaggtcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggtggaaccctggcagttctgctcccttcctaggatctgcccctgcattgtagcttgcttaacggagcacttctccttttccaaaggtctacattctagggtgtgggctgagt

SEQ ID NO: 47361 - DNA, 349 bp, Homo sapiens
atacattttcataacacactggagcatttgcgcttgcgacggtaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtccttctgatcaccccaagtagcatgactgatctgcaatttaaaattcctgtgatctgt

SEQ ID NO: 47362 - DNA, 468 bp, Homo sapiens
  misc_feature 1: n = A,T,C or G
naactacaggccaatagtcctgatgaacatacatgctttaatcctcaacaaaatactgatagacaatccaaacaatccagcaacaatcaaaaagataacacaccatgattaattggggtttatcctagggatgcatattcaaatatgttcatgttcaacctatgcaaatcaataaatgtgatacattgcatcaatagagtggacaaatatcttgataatttcaatagatgcagaaaaagcatttgataaaattcaacatcttttcatgataaaacctctcaacaaattaggcataaaaggagcatacttcaacattaataagggccatccatgacaaacccacagctaacgttatactaagtggggaaaagctgaaagccttttctctaagaattggaataaggcaaggttcccactccccactcgtattcagcgtagtactggaaatcccaaccggagcattcaggc

SEQ ID NO: 47363 - DNA, 482 bp, Homo sapiens
tcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggctttactggatcccaaaagcatttaaggtacatgttccaaaaactttgaaaagctaaatgtttcccatgatcgctcattcttcttttatgattcatacgttattcctctcacttgtaccccactaaaagtattagactacacattacattgaagttaaacacaaaattatcagtgttttagaaacatgagtccggactgtgtaagtaaaagtacaac

SEQ ID NO: 47364 - DNA, 238 bp, Homo sapiens
tgattttcccctatcaatgtatgggcaatcatcaccaaactgtgcaccagaatgtaactgccctgaaagctacccaagtgccatgtactgtgatgagctgaaattgaaaagtgaccaatggtgcctcctggaatcaagtatctttaccttaggaataaccagattgaccatattgatgaaaaggcctttgagaatgtaactgatctgcagtggctcattctagatcacaaccttctag

SEQ ID NO: 47365 - DNA, 278 bp, Homo sapiens
ataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaatagacttcaacactcgga

SEQ ID NO: 47366 - DNA, 216 bp, Homo sapiens
gaggtgggtagacccccatacgtcaaaaaaataatttcatgccacgcgtgtgaggagcacacctgtggtccgaattactggggagactgagccgagagaatgcctaccacttagaagtaattacgtagtcgtgagctaggacacgccacttgactctatcctggttgacagaaagacccttggctcaagtgaaaatacattacgatgcaagtgaaa

SEQ ID NO: 47367 - DNA, 102 bp, Homo sapiens
  misc_feature 6: n = A,T,C or G
tactancaaaataaaacatagcaaatggcatcactgtgtttgacttcttgtgaaatttctgtactttgtatataaaatacataaaacaatagattagaaatc

SEQ ID NO: 47368 - DNA, 224 bp, Homo sapiens
ttttaaaaagctctgagattcccatttcacttgagaatgctctacttacccagataaccaccatttatactgaaacgttcattcagtgtaagactgaacagtccctgagaaaaagacaaagcaacgaagtcagaaacatcaaccatgcgctttaaggccctgtcgctcactgtacttcagagtgggatataaaggcctagcttgggtaatggggaaggaaaaaa

SEQ ID NO: 47369 - DNA, 523 bp, Homo sapiens
ggagctgacgccatgaaggtcgagctgtgcagttttagcgggtacaagatctaccccggacacgggaggcgctacgccaggacccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagttcagctcccgagttggtggaaaacgctaaactggcagatagattttaaataaagatggatatacttt

SEQ ID NO: 47370 - DNA, 221 bp, Homo sapiens
actgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaaaaaaaaaaaaaaaaaaaaaaaaaaaaaa

SEQ ID NO: 47371 - DNA, 620 bp, Homo sapiens
attgtgatgtatatataaggtaatgtagggttatatttgggagtgactgcaagcatttttccatctgtgccaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggttctgatctgtactttgtgttagctacctttttatatttaaaaaaattaaaaatgaaaattacgtcttacaagcttaaagcttgatttgactttggttaaatgccaaaatgtacttaaatgagtacttagaatgccataaaattgcagttcatgcatgtatataatcatgcccatgtatatttaggtacgtataatgcttctgagtgagtttactcttaaatcatttggtaaacatttgcttgctgttactccctctgaggttttaattaaaaacttaaagataagctacataaacaatgatccatctaagcttatcttggggaaaccaa

SEQ ID NO: 47372 - DNA, 305 bp, Homo sapiens
ttgctcctgcgtgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtgctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctg

SEQ ID NO: 47373 - DNA, 331 bp, Homo sapiens
cccatgtgtgttgagagcttctcagactatccacctttgggtcgctttgctgttcgtgatatgagacagacagttgcggtgggtgtcatcaaagcagtggacaagaaggctgctggagctggcaaggcaccaagtctgcccagaaagctcagaaggctaaatgaatattatccctaatacctgccaccccactcttaatcagtggtggaagaacggtctcagaactgtttgttcaattggccatttaagtttagtagtaaaagactggttaatgataacaatgcatcgtaaaaccttcagaaggaaaggagaatgttttgtggaccacttt

SEQ ID NO: 47374 - DNA, 438 bp, Homo sapiens
tgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgatta

SEQ ID NO: 47375 - DNA, 235 bp, Homo sapiens
tcctctctcttgagaggatttcttgtgcacagagtatgaagcagttgtggagcgctgtgcctttgtcaagataccatcttgtttgatgatttctttctttgctgttttttcttcaaaatgttagtaagctctgtcatgcttctagcaaattgtaagactaattatttgtttccacctcataacctgttgcaataaatattacttctcaaaaaaaaaaaaaaaaaaaaaaaaaaaa

SEQ ID NO: 47376 - DNA, 597 bp, Homo sapiens
gagcctctctccctactgctgctacacaagaccctgagactgacctgcaggacgaaaccatgaagagcctgtccttcttgccatcctggccgccttagcggtagtaactttgtgttatgaaccacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggcaaatgagactgagggaagaaaaaaaatctctttttttctggaggctgcacctgattttgtatccccctgtagcagcattactgaaatacataggcttatatacaatgcttctttcctgtatattctcttgctggctgcacccctttttcccgccccagattgataagtaatgaaagtgcactgcagtgagggcaaaggagagcaacatatgtgatggtccataataaactttgg

SEQ ID NO: 47377 - DNA, 560 bp, Homo sapiens
cctgctttgaacgtactgttgaagcactgtacaagtttttggttcctaggccccgcagtgaatgttcaaagccagagcagctggctgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtaagttagatcaaagcaaatgtggactgaatctgcttgttgatcaagtgttgaagaaagtgcaaaaggacttttatatatttgacagtgtaggaaattgtctattcctgatataattaccggagtactctgcttaaggcaagaagttcagattactggtgaaataaaccactcttcttgg

SEQ ID NO: 47378 - DNA, 281 bp, Homo sapiens
aatcattgacgaccacagagctgggaaaattgttgcgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggc

SEQ ID NO: 47379 - DNA, 275 bp, Homo sapiens
actcaaaccagcagctaagttgtcagatagttcagaagatgagtgctacagccatacgagtctaattcatggacccctggcagaagcttttgtaaccaataggaaatacatttttcgtaaagaaagaagagctaatatttagtataggagccaaaataaagaacttaaaaccatttacatggatttttctagctagcaattagaaaagtgggcttgagatttgagggtcagcttatattcttaggggtgtggaggaagacagatgataaatttat

SEQ ID NO: 47380 - DNA, 495 bp, Homo sapiens
gatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaaggttattgatacttcccttttatgtaaaatgtagtagtgatacctatatttcccattgtgcattgtgacacacttgtctagggatgcctggaagtggataaaatgggactgca

SEQ ID NO: 47381 - DNA, 116 bp, Homo sapiens
gttaaagactattgtgacttcactgtgtataaacatattttatactttattgaaaggggacacctgtacattcttccatcgtcactgtaaagacagataaatgattatattcacac

SEQ ID NO: 47382 - DNA, 141 bp, Homo sapiens
ggaaaacgcttcaaagaggcaaataacgtcctgtggcccttcaaattgtcttctccacgaggtggaatgaagaaaaagaccacccattttgtagaaggtggagaggctggcaacagggaggaccagatcaacaggcttatt

SEQ ID NO: 47383 - DNA, 424 bp, Homo sapiens
atttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgccagatttctaaatgaaatgtttcactataacgctgctttagaatgaaggcttccagaagccacatccgcacaattttccacttaaccaggaaatatttctcctctaaatgcatgaaatcatg

SEQ ID NO: 47384 - DNA, 325 bp, Homo sapiens
gcatttgcaaaaaaaacaaatcatggctaattgattattttttggcagtgtggttaacatgtaaactcatgaagagcctgtgatttcctcactggatgatctctctctctgtaatcctcattgcaaattttcaccaggacagcgatttttgattagaggggagctctggcacagcatgctttaatctagcaggaacttccagatgatttaaattctcgatgctgtgatgacacacatatgatctttcgtgttctgagcgactctactttcattgtttgccagcgtggctccgttgctgttgcccaataaagcttgtgtaccgttc

SEQ ID NO: 47385 - DNA, 640 bp, Homo sapiens
acaactgccgcagacctgggtgtgaacccagtcccgtttgcactactggccagtcctacaaccagtattctcagagataccatcagagaacaagcactaatgttaattgcccaattgagtgcttcatgcctttagatgtacaggctgacagagaagattcccgagagtaaatcatctttccgatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgacattgcctgttctgcttcgaagtattcaatacccgctcagtattttaaatgaagtgatctaagatttgggttgggatcaataggaaaagcatatgcagccaccaagatgcaaatgttttgaaatgatatgaccaaaatttaagtaggaaagtcacccaaccttctgctttcacttaagttctggccgcaatactgtaggaacaagcatgatcttgtactgtgatatttaaatatccacagactcactttttccaaagatccta

SEQ ID NO: 47386 - DNA, 467 bp, Homo sapiens
acaggaaaaaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaattgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaattaaacctaaatatttggccaatagtttcagacttaaagcatcatagccc

SEQ ID NO: 47387 - DNA, 401 bp, Homo sapiens
  misc_feature 77: n = A,T,C or G
cggcagaacagggatgaagccttggacaacctcttggcttttgtctgtgacattcggccagaaatccatgaaaacgnaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttcttcttagactag

SEQ ID NO: 47388 - DNA, 267 bp, Homo sapiens
ccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcc

SEQ ID NO: 47389 - DNA, 300 bp, Homo sapiens
aagggatgtgagatgatctgttacttgcaacttcagctttattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaaaacaaaaaaagtt

SEQ ID NO: 47390 - DNA, 220 bp, Homo sapiens
taaactaggaaacgccatgatctattttaccaaggcctactgcggggcatgagcgacttttgcactttgaacatatcaccccatgctttcctgctaagaagtccacttttaaaaatgccttgtaatttttaaaaattcctctatttaacattctgctattgagtttaaggaaatacagtttcctcatgatgggggatcccttgaaaaaaaaaaaaaaaaa

SEQ ID NO: 47391 - DNA, 574 bp, Homo sapiens
  misc_feature 396, 397: n = A,T,C or G
gccacttctcgcctccgctggggaggtcctctttgcgcggtcatgagtcgcttcaagtttacggatattggtatcaacttgactgaccctatgttcagaggaatttataggggggttcaaaagcatcaagtttatgattacaggtggaaatctacaagacagtaaagatgcactgcatttggcacaaacaaatggtatgtttttcaagtacagttggatgtcatcctacaagatgtggtgaatttgaaaagaataaccctgatctttacttaaaggagatgctaaatcttgctgaaaacaataaagggaaagttgtggcaataggagaatgccggacttgattttgaccgactgcagtttgtcccaaagatctcaactcaaatatttgaaaacagnntgaactgcagacaaacaaaattaccaatgtttcttcattgtcgaaactcacatgctgaatttttggacataatgaaaagaaatagagatcggtgtggaggggggagtggtgcatttcatttggatggtacccaaggaagcagcagctgctttgattgacttgggatcttaatatagg

SEQ ID NO: 47392 - DNA, 349 bp, Homo sapiens
gctcatagctgcttttggcgcgaaagatgccttttctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggctgctgtgtgaataaataattcctgaagaatgaagaagattaattttgggagttctttgacgaactttgatatgtggaaaaagtatttataatttattgtaagaagaaagtaaaatattacta

SEQ ID NO: 47393 - DNA, 100 bp, Homo sapiens
tgcgtcaggtggctgttagctgataccatcaatagaacattcttttaattcatggaacttcaggaccatataagcctccatttcaaaaaaaaaaaaaaaa

SEQ ID NO: 47394 - DNA, 224 bp, Homo sapiens
ttcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagatttttccccttt

SEQ ID NO: 47395 - DNA, 438 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatg

SEQ ID NO: 47396 - DNA, 111 bp, Homo sapiens
acagagataacagcatatacaggccggactcttgaggcatagggctttacgcgtcaagaaggaacgaaagcagagcgggccagtaaggacaaaccaggggccaaaaatgag

SEQ ID NO: 47397 - DNA, 653 bp, Homo sapiens
ttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcagtgtcaccgatgcccagacttggagcaaggcaaccttggagcagtccactcataaaatatggtaacacccattttaaaatttaagttttgccttaaagacaacttcagtggtaattataaaagtgtggtacttcgcctaaattaaattgatagaaagatttaaaaatgtgtttggttctactatcagaaactgcgaactagggaagggtggtatgaaaaaatgtctttcctttttcaatgacataggtcaactctttcttggtacatttaaactatacccatggatatcaggctgctttggactcctctgctagggtacagacggaataaaacccttaattgaaccca

SEQ ID NO: 47398 - DNA, 162 bp, Homo sapiens
caggagctccttagtaaaggacttatcaaactggtttcaatgcacagagctcaagtaatttacaccagaaataccaagggtggagatgctccagctgctggtgaagatgcatgaataggtccaaccagctgtacatttggaaaaataaaactttattaaatc

SEQ ID NO: 47399 - DNA, 335 bp, Homo sapiens
gggggtggcccagaggaactcctcagggggatattttcatcgtggcttgggttacacggcatctgtcaacattcatggaccggtacaactaagatgttttgcatttcacagtatgtacatttaatctcaaaaaaagaacctaatagttaatcacgtgcatgttgaaatgtgtgggagtgaactgatgcctgcaccgtagttgaattgcatcagaaaatgaaatggacggacggacggacggatggacggacggatggatgggtggatagatatataataaagcaagtatgtagcaacatgttacaattataaaatgtagccggagtggaaggagg

SEQ ID NO: 47400 - DNA, 193 bp, Homo sapiens
gggtatatagagccacaacacatgtttattttgcttggctgcagttgaaaaatagaaattagtgccctggtgtgacctctcattccaagattgtcaattaaaaatgagtttaaaatgtttaacttgtgatcgagacctacatgcatgtcttgatattgtgtaactataatagagactctttaaggagaatctt

SEQ ID NO: 47401 - DNA, 100 bp, Homo sapiens
caaaacaacaataaaaaacatttctagaaaaccgagctcgagacgctcagggggggggcctctgacactaaggcagccggcacagtcaacacgcggagga

SEQ ID NO: 47402 - DNA, 552 bp, Homo sapiens
agaaagatagaacctttgctgttcttgcatacagcaatgtacaggaaagggaagcacagtttggaacaacagagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtgcagaaataccagaaggtgagaaactaattttttatgcatcttcaaaaaatgaagacaggttgttttttttcctgttttaagaaagaaacacaactttcatgattcattacccagccccttgtatggcaatattccagctacatttgatcctctaaaaattgcacaggcagctactttatgtaaaagcagtttacaaaagcaataaaatgtcacacagctgtaaaa

SEQ ID NO: 47403 - DNA, 115 bp, Homo sapiens
ccgacttataactggtgctgaccaagggaatccgattttttaactaaaacaaagcatcgcgaaggcccgcggcgggtgttgacgcgatgtgatttctgcccagtgctctgaatgt

SEQ ID NO: 47404 - DNA, 485 bp, Homo sapiens
aagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcagaacattaatgactttcttttcccttttatgtctgcttaatcagtgttaaactgctatgggaaaagtttatagaactatataacctgaatgttggtctctttgtacacatctttctatgactgcaaa

SEQ ID NO: 47405 - DNA, 412 bp, Homo sapiens
agatcatgcttcctgctactgctgatgtttaagctgaattcgccagcgactgccccatgaagttgccacttcacaaggtatcagatgatgatgacgatgatgatgatgatgatgacgatgatgatgatgatgatgatggtgatcatatccagagagaagcaaagtgaatgtgtaccatggcgtcttgaatccagcttggccataaggaaatggggcgagacttcgtcatgtatgtcgctgaagttcagctatgcaaaaatgttcacctatccttgatcaaccagtccaggaaccatcaaagaagaaaatgagattcgacttagaagacctgttctttataaacccctgcacagccctaatgatcaacaccacttccagtgctcataaattactgcttcaataattgttcttc

SEQ ID NO: 47406 - DNA, 324 bp, Homo sapiens
ttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgaaaaaaaaaaaaaaa

SEQ ID NO: 47407 - DNA, 105 bp, Homo sapiens
ataaccaaagccagataacttcaaagttgtcattaatatagttagccgaacataaacaaacaccggattatcgggggagcaggaaagagagagcaaggaggctat

SEQ ID NO: 47408 - DNA, 632 bp, Homo sapiens
gatttacagattgttataaattgttgagaaatttttgtgattagaatatgaaggaaaaagctttgttggtaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtggcccaccacttgagttgaggtgatttcatgggtctttccaggctcttgatagggtgcactgcatgcaagccatgaatctgttttgagaatcctctccattttcccaaataaaaacctatcccaacagtgactatatcactcagcattggatctaaatataaaagtggtgcttcagtgttttggcagatagtggtccataacctttccatcagaaggggatttaagacaccttagaggtccgtgctacatcttcacagttcctccgaataaccttagggggtagtggtacttgcctttgacacctggcctatgttttaatgactagatccaaactgggtggtcttaaacaaaaatgggaaatttttaatattatggata

SEQ ID NO: 47409 - DNA, 657 bp, Homo sapiens
ataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgcattgctggtcaagattactaatatttgggaaggctttaaagacgcatgttatggtgctaatgtactttcacttttaaactctagatcagaattgttgacttgcattcagaacataaatgcacaaaatctgacatgcttccatcagaaagatcatggcatgccacaggggattctcctcttcatcctgaaaaggtcaacaataaaaccaaattatgggctgctttgtcacactacatagagaatgggtggaaattaactttggaacctggatgtgggtggtggacctttttttccttacggcaccc

SEQ ID NO: 47410 - DNA, 123 bp, Homo sapiens
aatttgaaaaatatgcataaacagtctatgctgcctgggaggaaaagtctttttaagttaaacttatttactatagttatgatttatatatttaagaaaatgttctttatagagatttgttca

SEQ ID NO: 47411 - DNA, 596 bp, Homo sapiens
caatattttatggttatgttttcctgtgtgacagttttcatagtatccatattttattactgtgtattacttccatgaattttaaaatctgagggaaatgttttgtaaacatttattttttttaaagaaaagatgaaaggcaggcctatttcatcacaagaaaacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagctcatgcacttaaagaagtatttttaggaataagaattttgcatacttacctagggaaacttttctagaattatttttcactctaaggcatggatggttctctttgatattgcatggtatggttaatagctactagcaaaataaacatagcaaatgg

SEQ ID NO: 47412 - DNA, 332 bp, Homo sapiens
ggcaagaagaagccactgaaacagcccaagaagcagttcaaggagatggacgaggaagataaggcttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtcatttaagaataaacttttggaaaaaaaaaaa

SEQ ID NO: 47413 - DNA, 640 bp, Homo sapiens
ctgacagctttcgggccgagatgtctcgctccgtgtttttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtctacactgaattcacccccactgaaaaagatgagtatgcctgccgtgtgaaccatgtgactttgtcacagcccaagatagttaagtgggatcgagacatgtaagcagcatcatggaggttgaaagatgccgcatttggattggatgaattccaaattctgctgctgctttttaatattgatatgcttatacacttacactttatgcacaaaatgtagggtataataatggtaacatggacatgatctctttataatctactttgagggctggctccatgtttgatgatctgagcaggttgctcccaggtagctctaggagggctggcaacttaaagtgggggcagaaaattcttttatccaaat

SEQ ID NO: 47414 - DNA, 126 bp, Homo sapiens
cattatctgcatatgccaaaaaattttaagcaaatgaaagctaccaatttaaaattacggaatctaccattttaaagttaattgcttgtcaagctataaccacaaaaataatgaattgatgagaaa

SEQ ID NO: 47415 - DNA, 529 bp, Homo sapiens
gacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttgg

SEQ ID NO: 47416 - DNA, 547 bp, Homo sapiens
gcagaccagacttcgctcgtactcgtgcgcttcgcttcgcttttcctccgcaaccatgtctgacggaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccccttcacatcaaagaactactgacaacgaatgccgcgcctgcctttcccatctgtctatctatctggctggcagggaaggaaagaacttgcatgttggtgaaggaagaagtggggtggaagaagtggggtggggacgacagtgaaatctagagtaaaacccaagctggcccaaggttgtcctgcaggctgtaatgcagtttaatcagaagtgccattttttttttggtcc

SEQ ID NO: 47417 - DNA, 333 bp, Homo sapiens
ggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaaataaagccctcctggggacttggaaaaaaaaaaaaaaaaaaaaaaa

SEQ ID NO: 47418 - DNA, 275 bp, Homo sapiens
ctgccccggctttgacggatgaaaagctttcctgcttggcagttattcttccacaagagagggctttctcaggacctggttgctactgggtcggcaactgcagaaaatgtcctcccttgtggcttcctcagctcctgcccttggcctgaagtcccagcattgatggcagcgcctcatcttcaacttttgtgctcccctttgcctaaaccgtatggcctcccgtgcatctgtattcaccctgtatgacaaacacattacattattaaatgtttccc

SEQ ID NO: 47419 - DNA, 258 bp, Homo sapiens
tcccggaactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgg

SEQ ID NO: 47420 - DNA, 442 bp, Homo sapiens
cgcaagggaaagatgaaaaattataaccaagcataatatagcatggactaacccctatacctcctgcataatgaattaactagaaataactttgcaaggagagccaaagctaagacccccgaaaccagacgagctacctaagaacagctaaaagagcacacccgcctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccta

SEQ ID NO: 47421 - DNA, 280 bp, Homo sapiens
attgttatttttcttttacttcggtcagtgcacattagcatttgaactacctggggattctttatcagaactgtgcttgttgaatatttatacttaattgaaataattccttaagggaggccttgttcaaaacgtattaacaggaaattgtgtatgagatatttaatgaaatgagatattcgccaccgaatgagtaagtcacttcccaagtgtgtgcatttgttagaccctggggtacctgtcttgctattatgacatttcatttggaaggatgtttgtg

SEQ ID NO: 47422 - DNA, 375 bp, Homo sapiens
cacctagcttcccatgagcgcgggaggcatgccatggaggagtgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttaccgggcattctcaatacttgaatatggaacatatgcacaggggaaggaaataacattgcactttataaacactgtattgtaagtggaaaatgcaatgtcttaaataaaactatttaaaattggcacctaaaaaaaaaaaaa

SEQ ID NO: 47423 - DNA, 590 bp, Homo sapiens
taaaatctgtcgaaatgcaccatgaagctttgagtgaagctcttcctggggacaatgtgggcttcaatgtcagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgcattgttgatatggttcctgcaagcccatgtgtgttgagagcttctcagactatccacctttgggtcgctttgctgtcgtgatatgagacagacagttgcggtgggtgcatcaaggcagtggacaagaaggctgctggagctgcaaggtaccaagtctgccagaagcccaaaaggctaaatgaatattatccctaatcctgccacccactctaatcagtggtggaagaacgggctcaaactgttgttcaattgggcat

SEQ ID NO: 47424 - DNA, 239 bp, Homo sapiens
gaacagataaagattgtggggtgttctggatctggagagaattttactaatccgaaaagcagacacaaattatcggggtattcatatttgaactttctgttaaaatgcatgattgcaagaattgtttagattttgtgtttattcttgacgaaaagctttgactgttcttgattttaagtttgcactcaaatcttaagaaataaatccacccatgttatcaagacaaaaaaaaaaaaaaa

SEQ ID NO: 47425 - DNA, 340 bp, Homo sapiens
ctcgaattgctgacgcgtgcttaaagcatgctgcgagaagtagattttaagcagcgcatgaggctaccacccgttgtattcggggtccactgaatcgttaataatgaggagaggacaatgtgcttgtaaacatcatatttagcattaaagaaaagatgaaggggaggccggtttgatcacaaagaaatgcacacatatgcacgaatgggacatcagactcaatgccctattcgagccacccgagtcttaatcatgtgtagtgagaaacggacgtcgcgaacacgctttgtactcgattggccgttaaagagcagaggtatatagaccgttaaatgataac

SEQ ID NO: 47426 - DNA, 120 bp, Homo sapiens
aacgtagcaaataggaaatgcttaaacactgagagtgtttatgtttccaacaggataacaagagacgggggcatattgcaatgatgaattaaatccacatctaaaaaaaaaaaaaaaaaa

SEQ ID NO: 47427 - DNA, 620 bp, Homo sapiens
ggctctctgaccagcaccatggcggttggcaagaacaagcgctttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggcaaaaaatggcagacaatgattgaagctcacgttgatgtcaagactaccgatggttacttgctcgctgtctgtgtgggtttactaaaaacgcaacaatcagatccggaagacctcttatgctcacaccacaggtccgcaaatccggaagaagatgatggaaatcatgacccgagaggtgcagacaaatgacttgaaagaagtggtcaataaattgattcagacagcattggaaaagacatagaaaaggcttgccaatctatt

SEQ ID NO: 47428 - DNA, 328 bp, Homo sapiens
ggcaaatcgtagctattcttcactggtccttaaccttgttttgtaaaaagaaggctactctgtgtgggtagcggtaagagctgagtatagaaagccctcttacaaagagatggcaatatgctggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgt

SEQ ID NO: 47429 - DNA, 225 bp, Homo sapiens
gctttatttgtaaatatgctcttaatatgcaactttgagaataaaatagaaacatcatgtattttaaaatataagatgaagtgcgacgcactgtatacaatttaatatatatttttagggttttgttatttaagaaaatggaatgtaatggtacttttacaaaagagaaaaaatgttatttttactttctggaaaaaataaatattctcattgttgtagaatgag

SEQ ID NO: 47430 - DNA, 268 bp, Homo sapiens
agataaggctttcaagctgaaacaaaaagaggagcagaagaaactcgaggagctaaaagcgaaggcccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgt

SEQ ID NO: 47431 - DNA, 320 bp, Homo sapiens
attgaaaatcccctttagcttgttacagtagccaattgaaaatgtatatcccaaaatttaaaaaaaaaagtaccaggagcaataaaattgcactaggtttatctgggtcatacaaaaacagccatttaaatctggaggattcttggggaattgggtccctggtaagcaatggcggaaaccagcctggagcctagaaccggggcccctacgggctggggttaccccaaccttaaggtggtttattcattcgaattacagagactgggccttacagtgaatggcacctggctttttggagaacccaatgaacaacggtattc

SEQ ID NO: 47432 - DNA, 292 bp, Homo sapiens
tgaggcagccagcgcaggggcttctgctgagggggcaggcggtgcttgaggaaaccgcagataggtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgagcttcttcatggagtaaaaaatgtatt

SEQ ID NO: 47433 - DNA, 190 bp, Homo sapiens
tttctgtacatattcgtattctactattgagatactttatgattcctgtgagttgtgtacctggaaatataaaattgatattattattaatccattcagaaatcatattgggcaatagcactactacatgtacatttagtagcaaacatagatagaatatttggagataatgaagatttcaatactgtgt

SEQ ID NO: 47434 - DNA, 514 bp, Homo sapiens
ggagccgccaccaaaatgcagattttcgtgaaaacccttacggggaagaccatcacctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctgctgcctgaaatattataaggtggatgagaatggcaaaactagtcgccttcgtcgagagtgcccttctgatgaatgtggtgctggggtgtttatggcaagcactttgacagacattattgtggcaaatgttgtctgacttactgtttcaacaaaccagaagacaagtaactgtatgaagttaataaaagacatgaactagc

SEQ ID NO: 47435 - DNA, 222 bp, Homo sapiens
attagtatttaactatctccagagtttgtttaggagtaagaattgcccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtg

SEQ ID NO: 47436 - DNA, 154 bp, Homo sapiens
tttttgtatccgtgctaatgcacgttttaacatgatagacgcaatgcattgtgtagctagttttctggaaaagtcaatcttttaggaattgtttttcagatcttcaataaattttttctttaaatatcaaaaaaaaaaaaaaaaaaaaaaaaaa

SEQ ID NO: 47437 - DNA, 132 bp, Homo sapiens
gttgataagaggaatttggcataattatggtgggtgattattttttatactgtatgtgccaaagctttactactgtggaaagacaactgttttaataaaagatttacattccaaaaaaaaaaaaaaaaaaaa

SEQ ID NO: 47438 - DNA, 600 bp, Homo sapiens
aagtcattgcatatctgatcaataacttcagattctaagagtggatttgtttttttacatgggcccctatttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaaatgcgtgatttatattcagaacacctactatgtagcggttattttactgaatggggagatttaaacactgaggttctggtcaaaccgtgagtctgtctttgtgagaaatttacatatattggaagggaaatatgtctgagaaacaaatattgcatggggagtacttttagaattagaataactgtcca

SEQ ID NO: 47439 - DNA, 575 bp, Homo sapiens
agcaatagtttcagctagagattctgaacaagttgcagaattttaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgctgaggaaagaactgccattaaagagcagctggattcatctaatagtaccattgccattttacaaactgagaaagacaaactagagttggaaattacagattctaaaaaagacaagatgatctcttggtgctcttgccgatcaagatcagaaaatactgcattgaagaataaactcaaggatcttggtcatccagttgaagaagaggatgaccttgaatctgggaccaagaggatgaggatgatgaaagtgaagatcctgcaaggatctagacatatctaggttcaaatctctaggaacaa

SEQ ID NO: 47440 - DNA, 459 bp, Homo sapiens
ctttttgtgttctccaaaataaaggcaatgatttattttttccccagtgccaatacaatttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggtttatcaatcctgctaatgcttgccttggaacatctttcgcgtattcacgggttgtaggtgaaaggttactgtaaaaaaatcaaaacaaaaaaatgtattgttttacagaataaatttattggaatgcaaaaaaaaaaaa

SEQ ID NO: 47441 - DNA, 450 bp, Homo sapiens
tcaagaggctccaatcttcgtgttcactctaagaacactcgtgaaactgctcaggccatcaagggtatgcatatacgaaaagccacgaagtatctgaaagacgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagcaatgctgaacttaagggttagatgtagattctctggcattgagcatatccaagtgaacaaagcacctaagatgcgccgccggacctacagagctcatggtcggattaacccatacatgagctctccctgccacattgagatgatccttacggaaaaggaacagattgtcctaaaccagaagaggaggttgcccagaag

SEQ ID NO: 47442 - DNA, 572 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagacgatcttttaaaaagagattaaaccgaaggtgattaaaagaccttgaaatccatgacgcagggagaattgcgtcatttaaagcctagttaacgcatttactaaacgcagcgaaaatggaaagattaattggga

SEQ ID NO: 47443 - DNA, 406 bp, Homo sapiens
acactcttgttacctatgatatgggtccagagcccaaaatcattgatgctgctttgcgggcatgcacgacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgacctgg

SEQ ID NO: 47444 - DNA, 367 bp, Homo sapiens
atcctaaacgggtttagctctcgtctttcttctccttttttttaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgctgtttatatttttggaata

SEQ ID NO: 47445 - DNA, 128 bp, Homo sapiens
agcagttctggatggtgtgccttccagatcctctctggggctgtgttttgagcagcaggtagcctgctggttttatctgagtgaaatactgtacaggggaataaaagagatcttatttttttttttat

SEQ ID NO: 47446 - DNA, 390 bp, Homo sapiens
cgaagcttcaagactttgacatgtgtgaaaacatgaaatgacctttggctcttattgttcttgctggtgtggtatgttcacggctgaaaagatggtcagaaggggaaaggaggaagtgagaagaaagaaacagggaaatgcaggctgaggaattaccaaggaggcaggaggtggagcaaaacacaccaagcctggtgccaatcattgacaatattatggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgcc

SEQ ID NO: 47447 - DNA, 246 bp, Homo sapiens
aaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgccaaaaaaaaaaaaaaaaaaaaaaaaaaaa

SEQ ID NO: 47448 - DNA, 331 bp, Homo sapiens
cctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctggtccaccaaatacaattcaaatgctttttgttttatttttttaccaattccgatttcaaaatgtctcaatggtgctataataaataaacttcaacactctttatgataccc

SEQ ID NO: 47449 - DNA, 369 bp, Homo sapiens
tgtcagggagtgtttacttcgcctccacttctgttctttgcccgccctggtgctgctccggttcacatactcgtcctgagccggcttcagcctctctgcgcagaagtgtcccggagccatggccgagtaatcttatgcgaagtctaccaagcttgtgctcaagggaaccaagacgaagagtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacgatggtctttttaccctgggagctccacac

SEQ ID NO: 47450 - DNA, 229 bp, Homo sapiens
cagaaatacaatcgcatgctttacctgggacaaggctagttttcgacacgatccgagccagaaaaagagtaaggggggaccaactgagactgagaggcccgaaaactattacctggaggccaatcaacttgagaagttcgacataaagagctagttcaaatgtacacatataaaaaaggaaatagcgaacaggcaaaaacgcattcagccactcaatacctggagccgg

SEQ ID NO: 47451 - DNA, 261 bp, Homo sapiens
tgaatacgcaggaatgcgcttgctcgagaatagtttggaatggaccagagagggcactgagggttctgggttcattgaccagtgagctcaattgagataaacacaaatgccaaacactagctctgtattaatccccatcattactggtaaagcctcatttgaatgtgtgaattcaatacaggctatgtaaaatatttactaatgtcattattttgaaaaaataaatgtaaaaatacattcaaaatcaaaaaaaaaaaaaaa

SEQ ID NO: 47452 - DNA, 202 bp, Homo sapiens
actgtaatatttttaatcatcttaaagcatgattggatattttcttattgaaatgaccttatcatgtcttagagcccgtctttatgaggtgtccgagggacttcagtcaaactccccggagtgcgactgacggcagcttgatcactgctgcggtcaggcgctgttatgaggctctcgccatggcagagtcctgactggctgt

SEQ ID NO: 47453 - DNA, 140 bp, Homo sapiens
tggaacaaaacaagagcccactatccaaagcatgactgagcaaaagcgaacaaatctggaggcacaacattacgtgacttcgtactgtactataaacatattataacataacatagtttcttaaaaccaaatacacggat

SEQ ID NO: 47454 - DNA, 233 bp, Homo sapiens
aatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaccaggattctaggtggaggttgtgcatgttgtccttttaatctgatctgtgattaaagcagtaatatttaaggagggactgggaaa

SEQ ID NO: 47455 - DNA, 240 bp, Homo sapiens
ctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacacggaaaatatgtcaaagagcaggagcagtgactacacctgagaacatccagcggaggacaagagatttcatgt

SEQ ID NO: 47456 - DNA, 202 bp, Homo sapiens
attcctctacatgggctgtggctgtcagtccataggtttgtcagtttcacatcaaaactgtggggtataaactgttgaaacccactcacattaaaatattagctgggcacagtggtgtgcatctgtagtccagctacttgggagggctgaggcaggaggatcgcttaagcacaggagttggaatccagcctgagcaacagag

SEQ ID NO: 47457 - DNA, 237 bp, Homo sapiens
gcgccgcgaggtcgcgagattacactttaaaaagcatgaggaggcttgctttctacatgctgatttaatttcggaatacattcgagggcctgttctaaggtaggtgttatgatgctacaacttcttgaaaaagtaattgaatttggaaaatttgacagaggggaaaggcctcattgtccctcggggcaaaaaaatactttctcttcaggatcttaatctaaattcctgttaaataac

SEQ ID NO: 47458 - DNA, 221 bp, Homo sapiens
ccacaagaagttattggcaaacgaggttccgatatcatcattgtaggtcgtggcataatctcagcagcttatcgtcttgaagcagcagagatgtacaggaaagcttctttgggagcgtatttgagtagactttgtgtttgaggtcttcagatacagtttttagatacaatgtgaagacaatttagatatgtgtggccccccgagagtcactctgctctgag

SEQ ID NO: 47459 - DNA, 247 bp, Homo sapiens
ctggtctgaccgtcgcaaccctcatgaaggacaaccagcatatgctacaaggtacgcaataactgtttggtattttgatgcagattagagaacacgagctaaagtaaaatatctaacaggtgaaaaaggggtaagggttgaactcaataaaccttcagagttcggtcggtaaagacgtcttctagagaccctgatacagcgatatcccacttcaacctacactatagtgaactttatgtaaacacgt

SEQ ID NO: 47460 - DNA, 177 bp, Homo sapiens
catacctgaggttaaccttggatacgatagaaatgtaaggccaaggtcccggataaggaggattcctcccgatcagagagacttatttttgcttgcaagcagctggaagatagacgggactttgtgtgactacaaaatacaaagggggtctactcttcatattgtgttgagacttcg

SEQ ID NO: 47461 - DNA, 200 bp, Homo sapiens
tatctttctcttacctgtaatttatcaatttttcccagtatttttatacggaaaaaattgtattgaaaacacttagtatgcagttgataagaggaattttgtgtaattattggtgggggattattttttataccttaattggcccaaaggtttacttcttttggaaggcaactttttttataaaagagttttcaaatccc

SEQ ID NO: 47462 - DNA, 184 bp, Homo sapiens
ccttccttacaccttatacaaaaattaattcaagatggattaaagacttaaacgttagacccaaaaccataaaaaccctaggaggaaaccttggggattaccattaagggaaatgggcattgggcaaggactttaatttttaaaccaccaaaagcaaatgcaacaaaggccaaaatttgacaaa

SEQ ID NO: 47463 - DNA, 155 bp, Homo sapiens
ttactaaataaactaggtaggaattaaagctacccactgagagttaaggttattattctgcttcacgtaggggaaatttttaactaccctggaaaatttaaaaggggaaggaattgaatcttaactggtcttctaagtgttatctatctcccggt

SEQ ID NO: 47464 - DNA, 216 bp, Homo sapiens
tctgtgactgctctgcatcctctgcttttaaaaaaaccattgcaggtgccagtgtcccatatgttcctcctgacagtttgatgtgtccattctggggctctcagtgcttagcaagtaggtaatgtaaggggtgttggcagaatttggaatgactaccaacacacttcctatatcatttcactcagagtctatatttttgggttggcccagagcttc

SEQ ID NO: 47465 - DNA, 296 bp, Homo sapiens
aatgaggaaggaagtagcattagcagtaaagacccacaggccatgacctttttgatcactctgaggacaatatttaaatgacaggaaggtatattaatgtaacaagcattcctttaagggataggccaatttcttttgacctcttccttaaaggaagctttcaaactagcacatttctgtatctaacacatatggacaccactcccccacgcgtacacacacacgcacaaggagcttagggagtcagactgtcaagagtcacagtgcctcagtgcccagtagcgaattagagaaac

SEQ ID NO: 47466 - DNA, 166 bp, Homo sapiens
agctatcagcatcgggcgagagcctaacgtggccctagctggctcgcgcaacctctctaccggccatgaggcaacccagcggaccccaagatgcaggtttactaacggcatcagcagagaagtgaaaggcaaatcttcctgtatcgccaatgggcctgggtcataa

SEQ ID NO: 47467 - DNA, 151 bp, Homo sapiens
cataaaagtgcaaaagatacaacatttaaatagacaacaatatacagtcataaaatctacattctatacaagaacaaaataaccacaatagaatatctacctactaaattctttaccaaaccaaaatacaatctataaatcaaaaaaaaat

SEQ ID NO: 47468 - DNA, 255 bp, Homo sapiens
ccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagcacctcataggactatgaattcaccgaaattctcatttgccataaggccgagcttttaaagaaaaattgttctctacccagg

SEQ ID NO: 47469 - DNA, 251 bp, Homo sapiens
  misc_feature 38: n = A,T,C or G
aagcctgcgtcagattaaaacactgaactgacaattancagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtacccaaaactaa

SEQ ID NO: 47470 - DNA, 141 bp, Homo sapiens
agtgtggagatcagattaaatgtatgtaagacacttggcacaaaacctggcacatagtaaaggctcaataaaaacaagtgcctctcactgggctttgtcaacacgcgaaaaaaaaaaaaaaaaaaaaaaaaaaaaaaaatt

SEQ ID NO: 47471 - DNA, 281 bp, Homo sapiens
gcgagtgacacgcgggagggagagcagtgttctsgtggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggcttacctggctaaagagaggctcgaaattccactgcagaaggcaagatatccm

SEQ ID NO: 47472 - DNA, 335 bp, Homo sapiens
tcgtcttcggtttttctcttccttcgctaacgcctcccggctctcgtcagcctcccgccggccgtctccctaacaccgaacaccatgccttcaattaagttgcagagttctgatggagagatatttgaagttgatgtggaaattgccaaacaatctgtgactattaagaccatgttggaagatttggggatggatgatgaaggagatgatgacccagttcctctatccaaatgtgaatgcagcaatattaaaaacaggtcattcagttgtgcgcccacacacaaggatgagcctcctcctccctgaagattgatgagagacaaaggaaagcgagc

SEQ ID NO: 47473 - DNA, 330 bp, Homo sapiens
tggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaactttatttgctttcttctctttgttctttttgcttatatgtactttttaatgaatacgtgtctcacacacaaaaagaatgaggtttttctctcaagtaagaggcaaataatttgcagcaacttatgagggcaatggggcacctaaac

SEQ ID NO: 47474 - DNA, 208 bp, Homo sapiens
tgggggaaagtgtgagttctgaaggtgctgaagcgagaagccagatgctgagaaaaagaatgaaacatcacggggagacgttttcatcccggttaatcttgggattaagaggaggatgcggctggcacctcaaggctggatcacttgcgtacgtggatagtcgtagcttttaatgttgcgcctctgcaggtcctcaaggattctccgc

SEQ ID NO: 47475 - DNA, 217 bp, Homo sapiens
tgaggcagcagcgaggggcttctgctgagggggcaggcggactttgaggaaaccgcagataagtttttttctctttgacgatagagattaatacaactacttaaaaacaaatagtcaatcggttgctaagatattgcttagcgttaagtttttcacgtaattttcatagcttacgattttccgagaaaatatgcgacttagaaggagtagcatgagg

SEQ ID NO: 47476 - DNA, 149 bp, Homo sapiens
tagagtgatagtagatgagatgaggtggagagatgttgagtattggagtggtgtaaaaggtgactgagtgaagtgaaagtgtggtggatgaggatgaatgtacagtggttgattggatgatattgacgtgtgaattgggatcgagttgg

SEQ ID NO: 47477 - DNA, 131 bp, Homo sapiens
gacttctgccggctttgcaggatgaatgctttcctacttgcacttatcttccacaagagcagggcttctgaggcctggtagctactcgttcggcaactgcagcacatgtcctccctctgtagcttcctcaa

SEQ ID NO: 47478 - DNA, 170 bp, Homo sapiens
tgggaggtgttgggcgcggacagtcgagatgtcagagaaaaagcagccggtagacttaggtcttttagaggaagacgacgagtttgaagagttccctgccgaagacttggcctggcctagatgatgaatgaaggattgccacactgttctgggaggttaattgggattga

SEQ ID NO: 47479 - DNA, 196 bp, Homo sapiens
aggcagcagcgcaggggcttctgctgagggggcaggcggacttgaggaaccccagataagatttttctcttgaaagatagagattaatacacctactttaaaaattatagtccaatagggttactaagattattgcttagctttaagtttttcaccgtaatttcaatagcttaaggattttccagagaaaatatga

SEQ ID NO: 47480 - DNA, 158 bp, Homo sapiens
ctgagtctgttggcaccaagtgtcagcctcagcactcccggaactattgccaagaaggggcaagggatgagtcaagaaggtgagacccttcccggttgggcacgtgggccaaggctttttttagatttttggatgtttggtactttccatgactgggg

SEQ ID NO: 47481 - DNA, 141 bp, Homo sapiens
cactcgcagaccagacttcgctcgtactcgtgcgcctcgcttcgcttttcctccgcaaccatgtctgacaacccgatatggctgagatcgagaaattcgataagtcgaaactgaagaagacagagacgcaagaagaaaaat

SEQ ID NO: 47482 - DNA, 182 bp, Homo sapiens
gattctcctccttcatcctgtaaaggtcaacaataaaaaccaaattatggggctgcttttgtcacactagcatagagaatgtgttgaaatttaactttgtaagcttgtatgtggtggttgatcttttttttccttacagacacccataataaaatatcatattacgttcaaaaaaaaaaaaa

SEQ ID NO: 47483 - DNA, 447 bp, Homo sapiens
tgtgaagaaggaatagatttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatgggtggaaatgcaaataataccaagtaaaataatacagatattattaaagtttctgggtttgaggtgttgtagataaatgtatttatgtgcctagtggggaatccaatattatgaatatga

SEQ ID NO: 47484 - DNA, 270 bp, Homo sapiens
  misc_feature 5: n = A,T,C or G
tgtancatttttctaatagggctgccatatcttgctgtgtggagtatttttataattttatctgtataagctgtaatatcattttatagaaaatgcattatttagtcaattgtttaatgttggaaaacatatgaaatataaattatctgaatattagatgctctgagaaattgaatgtaccttatttaaaagattttatggttttataactatataaatgacattattaaagttttcaaattatttttcaaaaaaaaaaaaaaaaaaaaa

SEQ ID NO: 47485 - DNA, 627 bp, Homo sapiens
gaagctgacagcattcgggccgagatgtctcgctccgtggtcttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatggagggggtataataatggtaacatggcatgaacttctttataattctactttgagcgccgtctccatggttggatggatctgaagcagggtgctccacaggtagcctctagggaggggctgggcaacctt

SEQ ID NO: 47486 - DNA, 610 bp, Homo sapiens
  misc_feature 5, 12, 13, 19, 22, 23, 25, 26, 29, 38, 48: n = A,T,C or G
gaggnggtttanntggganctnngnnaanacttcggcnataatgggcnaagagctcatggagtgtgtgtctatgcgtgagctgtgtgtgtgctatattttaatcctcctggtcgtgcgacatggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgttcccttttttttgctcattttgttaaatttcaggtatttagctccctttcatattatttttaaatttttaattacctgtgaggggggtcctccagaacaaagagcaaaatttactgtgtgatgaccaatctaactaatggaattttaattcatgcgttaacatggctctcatttaagactttaa

SEQ ID NO: 47487 - DNA, 206 bp, Homo sapiens
aacatgcataagtgccaatcctttgaatgttccacggacacacttgtagacagattctagtgtctgaggaagaaacacggttttggttttggagaggtccacttggattggtgggttttcagagtttagggtatcgggcaaatcccttaacctttcccctaagggtgttccccttatgtttcagattttggattttctttggagct

SEQ ID NO: 47488 - DNA, 220 bp, Homo sapiens
tattctccgagcttcgcaatgccgcctaaggacgacaaggagaagaaggacgcttgaaagtcggccaagaaagacaaagaacccagttaacaaattccgggggcaaagccaaaaggaggagtgggggcaaaggcaaagttggggggcaagctctaataacttttgtttttttttgccacaaggtcatcccttttatactctctataggggggccccctct

SEQ ID NO: 47489 - DNA, 161 bp, Homo sapiens
tccactctttgacccagtattgttgaaaggagttcttcttaaactgtaaccaaaggaggcattattcttccgggaaaaatcttaagggaaagtatttcgggcaacaataggtctctttttggatctggggtctaaagggaagggttgggagaatttaaccc

SEQ ID NO: 47490 - DNA, 302 bp, Homo sapiens
gaggaagaagttgacaaactttgtcacggctgctgtcaggcttacacaatcccggacttacaaggttctttttgaggagagagtttttcacacacaaagtgattcccaccattagagagccctccccctttcacattgagaaattccccatataaggacccctctaagagaatatatactcttttgtaggagaagcaaagtagagtatataagtagtacacagctttgtgcccccagttgtgtctccacatactacgaggmcagcatatttgggtcggcactacacaggtttgtggtgggag

SEQ ID NO: 47491 - DNA, 141 bp, Homo sapiens
ctattaaatataagctctggaacttaattatttaacagtaaaattccataaataatctacctgactgcctaggtttaggtgtgggttgtctgaagcggacattcagaataaatctcttccaaaggatttcaaacccttaat

SEQ ID NO: 47492 - DNA, 121 bp, Homo sapiens
cctgcaggagcaggttctttggggcgtgaggcaggaagacactaggtgctgaatctctgcaaaacttggctggcttgaggccctgaggcaaccagatctgaataaaacagatgcttacccc

SEQ ID NO: 47493 - DNA, 207 bp, Homo sapiens
gcgtctcggaaacccggtagcgcttgcagcatggctgaccaactgacttaagagcagattgcaggattcaaagaaggtttttcactatttgacaaaggtggggtatggggactattacacacacaaggggatttggggactcttaatatagatattcttttggggagagatccccccaagagcagagattacagagcccagagtttw

SEQ ID NO: 47494 - DNA, 216 bp, Homo sapiens
caccacctttttgagacaagtcagaatttagattggtaatagtttgcaacttgactattaaaggataaccctggtcaattaacgtatacagtaaaaagagcttacttccctttctttgacttttattaagagataatatgaagggggtgtgcgtgggctcacgcgctgctaaattcccacactcttgggagaccacagggggagggagctactaca

SEQ ID NO: 47495 - DNA, 143 bp, Homo sapiens
ctttcattatctccacttccaattcccagtaccctgtgtaaaggaaaacatatacatttttgcaggacattttttaattgtgttttggtaattttagggtacataaaaattttattggtggctttgttttaaggcaatttttc

SEQ ID NO: 47496 - DNA, 379 bp, Homo sapiens
agcaggatttctctgcctcttcaaacttttcctccctgaacctgaggggaaactaattctggagttaactccctcttggttgaaaacccacctcaaaaagggagaattttctgattaaagaggggggtgaaaactagagagtggagaaggttattaaacgaaaaccttctaagcaataacgatgagcctcaaataaaaattgcacacactcagtgcagcattatattaccagccaggagtaaaaaagagatccatatcttaaagagacagctttcaggtgcctttctgcagtttttcaggagcgcaagatagatttggataggaataagctctagttctaaacaaccgacactcctacaggatttagaaaaagtttaca

SEQ ID NO: 47497 - DNA, 226 bp, Homo sapiens
acacccgtgaggaagttgcaagccaacaaaaaagttcaaggatctagaagacgattaagggaaggtcgttctcagttaaaatccaaaaaccagaaaaaaatgtttatacaaccctaagtcaataacctgaccttagaaaattgtgagagccaagttgactttaggaactgaaacatcagcacaaagaagcaatcatcaaataattctgaacacaaatttaatattt

SEQ ID NO: 47498 - DNA, 100 bp, Homo sapiens
ctattgtttttcatgaccataatttatttttaaaaataaattaagggtaattatatgcatgtatgtatttctaatgattaaaaatgtgttcaatccctga

SEQ ID NO: 47499 - DNA, 212 bp, Homo sapiens
attgtaaatcagagggaggttgggtttggtggttcatggctttattcccaacggttttgggaaggcaaggtgtgggggcagaatacaaagagatacagagaaatagagagtttcgagagccaaacctctaccccacaaatgtgtaaaacccccctctctytctctaaaatacacaaaaaattagaacacggcgtgtgggtgcacgcacctct

SEQ ID NO: 47500 - DNA, 193 bp, Homo sapiens
gcccaaaggattggtaggtattgtttttaattaacaataattattttataaataacctccccaaaaagagggaaaggggaaattttagaaatctttgatttggggccctgggaaacacaggtcaaagttcccaaagagttgggagggtaaaagggggcccagagagcgaccctacacgtaatacccaaggtct

SEQ ID NO: 47501 - DNA, 190 bp, Homo sapiens
aactctttggacctgatcttgatgcttctgctgctctgttaggctctgaagagcaatatctaatttattattactgtaattttttaaaaggctttaaagtgcctcaagggcccccggaaactaattttctaatttctggggatccccgggttcaaatatatgagatggggacaaaattagagggggttct

SEQ ID NO: 47502 - DNA, 530 bp, Homo sapiens
aggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatttcatttttttttttactagaaaggggggataaattaaggtacacaggtccccgtctaaaactttagtacttttccatgcagatttgtgcacatataagagggtgtcccgtttgtctagtgattgttatttagagagtgggcccccccttttgtgttgctaatcaatgactgtggtcccaaaagacctgtgaaaatttattccctctgtacaccgggtacataaaataaagccattttttw

SEQ ID NO: 47503 - DNA, 217 bp, Homo sapiens
gtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgctt

SEQ ID NO: 47504 - DNA, 167 bp, Homo sapiens
gtagagctctgtgaagagctgctacacatcgaatggttgagggatctcgcaaaggtattctttcaccatggccaacaacgaaggacttttcttcccttgtggcgaggaagctgagcagacccctgtgatgcctgtgaccccaattaaagcaattcctttgacctttg

SEQ ID NO: 47505 - DNA, 195 bp, Homo sapiens
gtctcctatttaaataaatagtgtttgtctgtagtcagtgttgggcaatctttgggggggattcttctctaatctttcagaaactttgtctgcgaaacactcttttaattgagcacatcacggattttagcgggagagcgcagtttatcttttatgggaagggagacaaatttttttttttatatagtgttgtgc

SEQ ID NO: 47506 - DNA, 203 bp, Homo sapiens
tgtgctcgcgctactctctctttctgacccgaggctatcagcgtacttcaaaggttcagaggttactcacggcaaaccgacagagaattggaagggcaaatttcccgaattgctatatgtcctcggggttcacacccacccacacattgagggtgagctttctctgagggagggggagagagttttaaaaaggggggggatca

SEQ ID NO: 47507 - DNA, 200 bp, Homo sapiens
tttgacaaaactgagggacagccttcggtcagtacaaatatcaattctctccattttcgtctagcagttggaggaggcctttatatcttttggtataacagaaacaagactctttaaaggtggggaaaaacaattggaggtaaaactttccaaggccctgggaatctttacagcgggggggggctgcactttaccctaaa

SEQ ID NO: 47508 - DNA, 183 bp, Homo sapiens
catctgtgagcccgcggaggtatacaccatgagcaaagctcaccctccgagttgaaaaatttatggacaaggagttatcattgaaattaaattgggggcagacatgttcaaggaatattgcggggatttgatccctttatgaaccttgtgataaatgaatgtgtagagaacgcgactagtgga

SEQ ID NO: 47509 - DNA, 231 bp, Homo sapiens
gattcccgagagtaaatcatctttccaatccagaggacaagcatgtctctcttccaaggtccatctaaactgggggtgatgttaggagaccccgcttagagttcttctttctttcttaagccccttgctctgtgaggaagttctcccgcttcagctcaactcacagcttctccaagcatcacccggggagtttcccgagggggttctcataaatgaggggtgcacactttc

SEQ ID NO: 47510 - DNA, 126 bp, Homo sapiens
cactgtgtataccgctactaccactgcaattcacattatatttgaatggacaattcacatgtctaccacaaggctttaaacataaccctatttgagatgaattgcaataaagctctgttacaacgt

SEQ ID NO: 47511 - DNA, 163 bp, Homo sapiens
tctgaggcgttttgtttgagtgcaccctgctggttagaggtgcaagcagatgaggaatccagacattgcatgtggggggtcttcagctccaggaaagggggggggggaaataatttttgggtcttgtgcaataaaaaggtgaccctaactctctcgagggggt

SEQ ID NO: 47512 - DNA, 113 bp, Homo sapiens
aattactttggccactgcagtccagggagtaaatgaaatgataactccaagtggtgaaagcaggacaaacaaaaaaacaaaacttttcagccaaaaatatttttacccggggg

SEQ ID NO: 47513 - DNA, 166 bp, Homo sapiens
tcttgagacctataagagatcagtggaagagtaagggttggttcatcatcacaaggaataaaaaacatagtgatttcccctcttaaatgtgtagaggtggttttacttggcaataattaataatagaccctccctcccaatttgtgagcatatttactaaaatatg

SEQ ID NO: 47514 - DNA, 206 bp, Homo sapiens
ttgaagagtaattatgcttatgtggagattgtgtatgtgaaatgaagaaattatatttattggtagtggattttttttaactggtaaagatggatttggaaaaaaagtgtttcataaaaaaggttgggtaattcaatacagagatgaattttagttgtaagggaaattgggttgaatttttgtgttttaaagggaatttttatagt
